(12) United States Patent
Zelder et al.

(10) Patent No.: US 7,141,664 B2
(45) Date of Patent: Nov. 28, 2006

(54) GENES CODING CARBON METABOLISM AND ENERGY-PRODUCING PROTEINS

(75) Inventors: Oskar Zelder, Speyer (DE); Markus Pompejus, Waldsee (DE); Hartwig Schröder, Nussloch (DE); Burkhard Kröger, Limburgerhof (DE); Corinna Klopprogge, Mannheim (DE); Gregor Haberhauer, Limburgerhof (DE)

(73) Assignee: Basf Aktiengesellschaft (DE)

( * ) Notice: Subject to any disclaimer, the term of this patent is extended or adjusted under 35 U.S.C. 154(b) by 280 days.

(21) Appl. No.: 10/494,836

(22) PCT Filed: Oct. 31, 2002

(86) PCT No.: PCT/EP02/12135

§ 371 (c)(1),
(2), (4) Date: May 5, 2004

(87) PCT Pub. No.: WO03/040291

PCT Pub. Date: May 15, 2003

(65) Prior Publication Data

US 2005/0014233 A1    Jan. 20, 2005

(30) Foreign Application Priority Data

Nov. 5, 2001 (DE) ................. 101 54 270

(51) Int. Cl.
| | | |
|---|---|---|
| *C07H 21/04* | (2006.01) | |
| *C12N 1/20* | (2006.01) | |
| *C12N 15/00* | (2006.01) | |
| *C12P 21/06* | (2006.01) | |

(52) U.S. Cl. ................. 536/23.7; 435/69.1; 435/252.3; 435/320.1

(58) Field of Classification Search ............... 536/23.7; 435/69.1, 252.3, 320.1
See application file for complete search history.

(56) References Cited

FOREIGN PATENT DOCUMENTS

| EP | 1 108 790 A2 | 6/2001 |
|---|---|---|
| WO | WO 01/00805 A2 | 1/2001 |
| WO | WO 01/00844 A2 | 1/2001 |

OTHER PUBLICATIONS

EMBL Accession No. AAG91435 for C glutamicum protein fragment SEQ ID No. 5189.
EMBL Accession No. AAH66654 for C glutamicum coding sequence fragment SEQ ID No. 1689.

*Primary Examiner*—Mark Navarro
(74) *Attorney, Agent, or Firm*—Lahive & Cockfield, LLP; Elizabeth A. Hanley; Maria Laccotripe Zacharakis

(57) ABSTRACT

The invention relates to novel nucleic acid molecules, to the use thereof for constructing genetically improved microorganisms and to methods for preparing fine chemicals, in particular amino acids, with the aid of said genetically improved microorganisms.

20 Claims, No Drawings

GENES CODING CARBON METABOLISM AND ENERGY-PRODUCING PROTEINS

BACKGROUND OF THE INVENTION

Particular products and byproducts of naturally occurring metabolic processes in cells are suitable for in many branches of industry, including the food industry, the animal feed industry, the cosmetics industry and the pharmaceutical industry. These molecules which are collectively referred to as "fine chemicals" comprise organic acids, both proteinogenic and nonproteinogenic amino acids, nucleotides and nucleosides, lipids and fatty acids, diols, carbohydrates, aromatic compounds, vitamins, cofactors and enzymes. They are best produced by means of cultivating, on a large scale, bacteria which have been developed to produce and secrete large amounts of the molecule desired in each particular case. An organism which is particularly suitable for this purpose is *Corynebacterium glutamicum*, a Gram-positive nonpathogenic bacterium. Using strain selection, a number of mutant strains have been developed which produce various desirable compounds. The selection of strains which are improved with respect to the production of a particular molecule is, however, a time-consuming and difficult process.

BRIEF DESCRIPTION OF THE INVENTION

The present invention provides novel nucleic acid molecules which can be used for identifying or classifying *Corynebacterium glutamicum* or related bacterial species. *C. glutamicum* is a Gram-positive, aerobic bacterium which is widely used in industry for the large-scale production of a number of fine chemicals and also for the degradation of hydrocarbons (such as, for example in the case of crude oil spills) and for the oxidation of terpenoids. The nucleic acid molecules may therefore be used for identifying microorganisms which can be used for producing fine chemicals, for example by fermentation processes. Although *C. glutamicum* itself is nonpathogenic, it is, however, related to other *Corynebacterium* species such as *Corynebacterium diphteriae* (the diphtheria pathogen), which are major pathogens in humans. The ability to identify the presence of *Corynebacterium* species may therefore also be of significant clinical importance, for example in diagnostic applications. Moreover, said nucleic acid molecules may serve as reference points for mapping the *C. glutamicum* genome or genomes of related organisms.

These novel nucleic acid molecules encode proteins which are referred to herein as sugar metabolism and oxidative phosphorylation (SMP) proteins. These SMP proteins have, for example, a function in the metabolism of carbon compounds such as sugars or in the generation of energy molecules in *C. glutamicum* by processes such as oxidative phosphorylation. Owing to the availability of cloning vectors usable in *Corynebacterium glutamicum*, as disclosed, for example in Sinskey et al., U.S. Pat. No. 4,649,119, and of techniques for the genetic manipulation of *C. glutamicum* and the related *Brevibacterium* species (e.g. *lactofermentum*) (Yoshihama et al., J. Bacteriol. 162: 591–597 (1985); Katsumata et al., J. Bacteriol. 159: 306–311 (1984); and Santamaria et al. J. Gen. Microbiol. 130: 2237–2246 (1984)), the nucleic acid molecules of the invention can be used for genetic manipulation of said organism in order to make it a better and more efficient producer of one or more fine chemicals. The improved production or efficiency of production of a fine chemical may result directly or indirectly from manipulation of a gene of the invention.

There is a number of mechanisms by which modification of an SMP protein of the invention can directly influence the yield, production and/or efficiency of production of a fine chemical from a *C. glutamicum* strain containing this modified protein. The degradation of energy-rich carbon molecules, for example sugars, and the conversion of compounds such as NADH and $FADH_2$ into compounds with energy-rich phosphate bonds via oxidative phosphorylation leads to a number of compounds which themselves may be desirable fine chemicals, such as pyruvate, ATP, NADH, and to a number of sugar intermediates. Furthermore, the energy molecules (such as ATP) and reduction equivalents (such as NADH or NADPH) which are produced by these metabolic pathways are used in the cell for driving reactions which otherwise would be energetically unfavorable. Such unfavorable reactions include many biosynthetic pathways of fine chemicals. By improving the ability of the cell to utilize a particular sugar (e.g. by manipulating the genes involved in the degradation and conversion of said sugar into energy for the cell) it is possible to increase the amount of energy available for unfavorable, yet desired, metabolic reactions (e.g. biosynthesis of a fine chemical of interest) to take place.

The mutagenesis of one or more SMP proteins of the invention may also lead to SMP proteins with altered activities, which influence indirectly the production of one or more fine chemicals of interest from *C. glutamicum*. For example, it is possible, by increasing the efficiency of utilizing one or more sugars (so as to improve conversion of said sugar into utilizable energy molecules) or by increasing the efficiency of converting reduction equivalents into utilizable energy molecules (e.g. by improving the efficiency of oxidative phosphorylation or the activity of ATP synthase), to increase the amount of these energy-rich compounds which is available to the cells for driving metabolic processes which normally are unfavorable. These processes include construction of the cell walls, transcription, translation and the biosynthesis of compounds required for cell growth and cell division (e.g. nucleotides, amino acids, vitamins, lipids, etc.) (Lengeler et al. (1999) Biology of Prokaryotes, Thieme Verlag: Stuttgart, pp. 88–109; 913–918; 875–899). Improving the growth and propagation of these modified cells makes it possible to increase the viability of said cells in large-scale cultures and also to improve their rate of division so that a comparatively larger number of cells can survive in the fermentative culture. The yield, production or efficiency of production may be increased, at least due to the presence of a larger number of viable cells which in each case produce the fine chemical of interest. Many of the degradation products produced during sugar metabolism, too, are used by the cell as precursors or intermediates in the production of other desirable products, for example fine chemicals. Thus an increase in the ability of the cell to metabolize sugar should increase the number of said degradation products which are available to the cell for other processes.

The present invention provides novel nucleic acid molecules encoding the proteins referred to herein as SMP proteins which, for example, may exert a function which is involved in the metabolism of carbon compounds such as sugars and in the generation of energy molecules in *Corynebacterium glutamicum* by processes such as oxidative phosphorylation. Nucleic acid molecules encoding an SMP protein are referred to herein as SMP nucleic acid molecules. In a preferred embodiment, the SMP protein is involved in the conversion of carbon molecules and degradation products thereof into energy which is used by the cell for metabolic processes. Examples of such proteins are those encoded by the genes listed in Table 1.

Consequently, one aspect of the invention relates to isolated nucleic acid molecules (e.g. cDNAs) comprising a nucleotide sequence which encodes an SMP protein or biologically active sections thereof and also nucleic acid fragments which are suitable as primers or hybridization probes for detecting or amplifying SMP-encoding nucleic acid (e.g. DNA or mRNA). In particularly preferred embodiments, the isolated nucleic acid molecule comprises any of the nucleotide sequences listed in Appendix A or the coding region of any of these nucleotide sequences or a complement thereof. In other preferred embodiments, the isolated nucleic acid molecule encodes any of the amino acid sequences listed in Appendix B. The preferred SMP proteins of the invention likewise have preferably at least one of the SMP activities described herein.

Appendix A defines hereinbelow the nucleic acid sequences of the sequence listing together with the sequence modifications at the relevant position, described in Table 1.

Appendix B defines hereinbelow the polypeptide sequences of the sequence listing together with the sequence modifications at the relevant position, described in Table 1.

In a further embodiment, the isolated nucleic acid molecule is at least 15 nucleotides in length and hybridizes under stringent conditions to a nucleic acid molecule which comprises a nucleotide sequence of Appendix A. The isolated nucleic acid molecule preferably corresponds to a naturally occurring nucleic acid molecule. The isolated nucleic acid more preferably encodes a naturally occurring *C. glutamicum* SMP protein or a biologically active section thereof.

A further aspect of the invention relates to vectors, for example recombinant expression vectors, which contain the nucleic acid molecules of the invention and to host cells into which said vectors have been introduced. In one embodiment, an SMP protein is prepared by using this host cell, the host cell being cultivated in a suitable medium. The SMP protein may then be isolated from the medium or the host cell.

A further aspect of the invention relates to a genetically modified microorganism into which an SMP gene has been introduced or in which an SMP gene has been modified. In one embodiment, the genome of said microorganism has been modified by introducing at least one inventive nucleic acid molecule which encodes the mutated SMP sequence as transgene. In another embodiment, an endogenous SMP gene in the genome of said microorganism has been modified, for example, functionally disrupted, by homologous recombination with a modified SMP gene. In a preferred embodiment, the microorganism belongs to the genus *Corynebacterium* or *Brevibacterium*, with *Corynebacterium glutamicum* being particularly preferred. In a preferred embodiment, the microorganism is also used for preparing a compound of interest, such as an amino acid, lysine being particularly preferred.

Another preferred embodiment are host cells having more than one of the nucleic acid molecules described in Appendix A. Such host cells can be prepared in various ways known to the skilled worker. They may be transfected, for example, by vectors carrying several of the nucleic acid molecules of the invention. However, it is also possible to use a vector for introducing in each case one nucleic acid molecule of the invention into the host cell and therefore to use a plurality of vectors either simultaneously or sequentially. Thus it is possible to construct host cells which carry numerous, up to several hundred, nucleic acid sequences of the invention. Such an accumulation can often produce superadditive effects on the host cell with respect to fine-chemical productivity.

A further aspect of the invention relates to an isolated SMP protein or a section thereof, for example a biologically active section. In a preferred embodiment, the isolated SMP protein or its section may exert a function in *Corynebacterium glutamicum*, which is involved in the metabolism of carbon compounds such as sugars or in the generation of energy molecules (e.g. ATP) by processes such as oxidative phosphorylation. In a further preferred embodiment, the isolated SMP protein or a section thereof is sufficiently homologous to an amino acid sequence of Appendix B for the protein or its section to retain the ability to exert a function in *Corynebacterium glutamicum*, which is involved in the metabolism of carbon compounds such as sugars or in the generation of energy molecules (e.g. ATP) by processes such as oxidative phosphorylation.

Moreover, the invention relates to an isolated SMP protein preparation. In preferred embodiments, the SMP protein comprises an amino acid sequence of Appendix B. In a further preferred embodiment, the invention relates to an isolated full-length protein which is essentially homologous to a complete amino acid sequence of Appendix B (which is encoded by an open reading frame in Appendix A).

The SMP polypeptide or a biologically active section thereof may be functionally linked to a non-SMP polypeptide in order to produce a fusion protein. In preferred embodiments, this fusion protein has a different activity from that of the SMP protein alone. In other preferred embodiments, said fusion protein exerts a function in *Corynebacterium glutamicum*, which is involved in the metabolism of carbon compounds such as sugars or in the generation of energy molecules (e.g. ATP) by processes such as oxidative phosphorylation. In particularly preferred embodiments, integration of said fusion protein into a host cell modulates the production of a compound of interest by the cell.

A further aspect of the invention relates to a method for preparing a fine chemical. The method provides for the cultivation of a cell containing a vector which causes expression of an SMP nucleic acid molecule of the invention so that a fine chemical is produced. In a preferred embodiment, this method moreover comprises the step of obtaining a cell containing such a vector, said cell being transfected with a vector which causes expression of an SMP nucleic acid. In a further preferred embodiment, said method moreover comprises the step in which the fine chemical is obtained from the culture. In a particularly preferred embodiment, the cell belongs to the genus *Corynebacterium* or *Brevibacterium*.

A further aspect of the invention relates to methods for modulating the production of a molecule from a microorganism. These methods comprise contacting the cell with a substance which modulates SMP-protein activity or SMP nucleic-acid expression such that a cell-associated activity is modified in comparison with the same activity in the absence of said substance. In a preferred embodiment, the cell is modulated with respect to one or more carbon metabolic pathways of *C. glutamicum* or to the generation of energy by processes such as oxidative phosphorylation so as to improve the yield or the rate of production of a fine chemical of interest by said microorganism. The substance which modulates SMP-protein activity may be a substance which stimulates SMP-protein activity or SMP nucleic-acid expression. Examples of substances stimulating SMP protein activity or SMP nucleic-acid expression include small molecules, active SMP proteins and nucleic acids which encode SMP proteins and have been introduced into the cell. Examples of substances which inhibit SMP activity or SMP expression include small molecules and SMP antisense nucleic acid molecules.

A further aspect of the invention relates to methods for modulating the yields of a compound of interest from a cell, comprising introducing an SMP wild-type gene or SMP-mutant gene into a cell, which gene either remains on a separate plasmid or is integrated into the genome of the host cell. Integration into the genome may take place randomly or via homologous recombination so that the native gene is replaced by the integrated copy, leading to the production of the compound of interest from the cell to be modulated. In a preferred embodiment, said yields are increased. In a further preferred embodiment, the chemical is a fine chemical which, in a particularly preferred embodiment, is an amino acid. In a particularly preferred embodiment, this amino acid is L-lysine.

DETAILED DESCRIPTION OF THE INVENTION

The present invention provides SMP nucleic acid and SMP-protein molecules which are involved in the metabolism of carbon compounds such as sugars and in the generation of energy molecules by processes such as oxidative phosphorylation in *Corynebacterium glutamicum*. The molecules of the invention can be used for modulating the production of fine chemicals from microorganisms such as *C. glutamicum* either directly (for example, when overexpression or optimization of a protein of the glycolytic pathway has a direct effect on the yield, production and/or efficiency of production of, for example, pyruvate from modified *C. glutamicum*) or via an indirect effect which nevertheless leads to an increase in the yield, production and/or efficiency of production of the compound of interest (for example, when modulation of proteins involved in oxidative phosphorylation leads to changes in the amount of energy available for carrying out necessary metabolic processes and other cellular functions such as nucleic acid and protein biosynthesis and transcription/translation). The aspects of the invention are further illustrated below.

I. Fine Chemicals

The term "fine chemicals" is known in the art and includes molecules which are produced by an organism and are used in various branches of industry such as, for example, but not restricted to, the pharmaceutical industry, the agricultural industry and the cosmetics industry. These compounds comprise organic acids such as tartaric acid, itaconic acid and diaminopimelic acid, both proteinogenic and nonproteinogenic amino acids, purine and pyrimidine bases, nucleosides and nucleotides (as described, for example, in Kuninaka, A. (1996) Nucleotides and related compounds, pp. 561–612, in Biotechnology Vol. 6, Rehm et al., Editors VCH: Weinheim and the references therein), lipids, saturated and unsaturated fatty acids (e.g. arachidonic acid), diols (e.g. propanediol and butanediol), carbohydrates (e.g. hyaluronic acid and trehalose), aromatic compounds (e.g. aromatic amines, vanilline and indigo), vitamins and cofactors (as described in Ullmann's Encyclopedia of Industrial Chemistry, Vol. A27, "Vitamins", pp. 443–613 (1996) VCH: Weinheim and the references therein; and Ong, A. S., Niki, E. and Packer, L. (1995) "Nutrition, Lipids, Health and Disease" Proceedings of the UNESCO/Confederation of Scientific and Technological Associations in Malaysia and the Society for Free Radical Research—Asia, held Sep. 1–3, 1994 in Penang, Malaysia, AOCS Press (1995)), enzymes and all other chemicals described by Gutcho (1983) in Chemicals by Fermentation, Noyes Data Corporation, ISBN: 0818805086 and the references indicated therein. The metabolism and the uses of particular fine chemicals are further illustrated below.

A. Metabolism and Uses of Amino Acids

Amino acids comprise the fundamental structural units of all proteins and are thus essential for normal functions of the cell in all organisms. The term "amino acid" is known in the art. Proteinogenic amino acids, of which there are 20 types, serve as structural units for proteins, in which they are linked together by peptide bonds, whereas the nonproteinogenic amino acids (hundreds of which are known) usually do not occur in proteins (see Ullmann's Encyclopedia of Industrial Chemistry, Vol. A2, pp. 57–97 VCH: Weinheim (1985)). Amino acids can exist in the optical D or L configuration, although L-amino acids are usually the only type found in naturally occurring proteins. Biosynthetic and degradation pathways of each of the 20 proteinogenic amino acids are well characterized both in prokaryotic and eukaryotic cells (see, for example, Stryer, L. Biochemistry, $3^{rd}$ edition, pp. 578–590 (1988)). The "essential" amino acids (histidine, isoleucine, leucine, lysine, methionine, phenylalanine, threonine, tryptophan and valine), so called because, owing to the complexity of their biosyntheses, they must usually be taken in with the diet, are converted by simple biosynthetic pathways into the other 11 "nonessential" amino acids (alanine, arginine, asparagine, aspartate, cysteine, glutamate, glutamine, glycine, proline, serine and tyrosine). Higher animals are able to synthesize some of these amino acids but the essential amino acids must be taken in with the food in order that normal protein synthesis takes place.

Apart from their function in protein biosynthesis, these amino acids are interesting chemicals as such, and it has been found that many have various applications in the human food, animal feed, chemicals, cosmetics, agricultural and pharmaceutical industries. Lysine is an important amino acid not only for human nutrition but also for monogastric livestock such as poultry and pigs. Glutamate is most frequently used as flavor additive (monosodium glutamate, MSG) and elsewhere in the food industry, as are aspartate, phenylalanine, glycine and cysteine. Glycine, L-methionine and tryptophan are all used in the pharmaceutical industry. Glutamine, valine, leucine, isoleucine, histidine, arginine, proline, serine and alanine are used in the pharmaceutical industry and the cosmetics industry. Threonine, tryptophan and D/L-methionine are widely used animal feed additives (Leuchtenberger, W. (1996) Amino acids—technical production and use, pp. 466–502 in Rehm et al., (editors) Biotechnology Vol. 6, Chapter 14a, VCH: Weinheim). It has been found that these amino acids are additionally suitable as precursors for synthesizing synthetic amino acids and proteins, such as N-acetylcysteine, S-carboxymethyl-L-cysteine, (S)-5-hydroxytryptophan and other substances described in Ullmann's Encyclopedia of Industrial Chemistry, Vol. A2, pp. 57–97, VCH, Weinheim, 1985.

The biosynthesis of these natural amino acids in organisms able to produce them, for example bacteria, has been well characterized (for a review of bacterial amino acid biosynthesis and its regulation, see Umbarger, H. E. (1978) Ann. Rev. Biochem. 47: 533–606). Glutamate is synthesized by reductive amination of α-ketoglutarate, an intermediate product in the citric acid cycle. Glutamine, proline and arginine are each generated successively from glutamate. The biosynthesis of serine takes place in a three-step process, starts with 3-phosphoglycerate (an intermediate product of glycolysis) and affords this amino acid after oxidation, transamination and hydrolysis steps. Cysteine and glycine are each produced from serine, specifically the former by condensation of homocysteine with serine, and the latter by transfer of the side-chain β-carbon atom to tetrahydrofolate in a reaction catalyzed by serine transhydroxy-methylase. Phenylalanine and tyrosine are synthesized from the precursors of the glycolysis and pentose phosphate pathway, and erythrose 4-phosphate and phosphoenolpyruvate in a 9-step biosynthetic pathway which diverges only in the last two steps after the synthesis of prephenate. Tryptophan is likewise produced from these two starting molecules but it is synthesized by an 11-step pathway. Tyrosine can also be prepared from phenylalanine in a reaction catalyzed by phenylalanine hydroxylase. Alanine, valine and leucine are each biosynthetic products derived from pyruvate, the final product of glycolysis. Aspartate is formed from oxalacetate, an intermediate product of the citrate cycle. Asparagine, methionine, threonine and lysine are each produced by the conversion of aspartate. Isoleucine is formed from threonine. Histidine is formed from 5-phosphoribosyl 1-pyrophosphate, an activated sugar, in a complex 9-step pathway.

Amounts of amino acids exceeding those required for protein biosynthesis cannot be stored and are instead broken down so that intermediate products are provided for the principal metabolic pathways in the cell (for a review, see Stryer, L., Biochemistry, $3^{rd}$ edition, Chapter 21 "Amino Acid Degradation and the Urea Cycle"; pp. 495–516 (1988)). Although the cell is able to convert unwanted amino acids into the useful intermediate products of metabolism, production of amino acids is costly in terms of energy, the precursor molecules and the enzymes necessary for their synthesis. It is therefore not surprising that amino acid biosynthesis is regulated by feedback inhibition, whereby the presence of a particular amino acid slows down or completely stops its own production (for a review of feedback mechanisms in amino acid biosynthetic pathways, see Stryer, L., Biochemistry, 3rd edition, Chapter 24, "Biosynthesis of Amino Acids and Heme", pp. 575–600 (1988)). The output of a particular amino acid is therefore restricted by the amount of this amino acid in the cell.

B. Metabolism and Uses of Vitamins, Cofactors and Nutraceuticals

Vitamins, cofactors and nutraceuticals comprise another group of molecules. Higher animals have lost the ability to synthesize them and therefore have to take them in, although they are easily synthesized by other organisms such as bacteria. These molecules are either bioactive molecules per se or precursors of bioactive substances which serve as electron transfer molecules or intermediate products in a number of metabolic pathways. Besides their nutritional value, these compounds also have a significant industrial value as colorants, antioxidants and catalysts or other processing auxiliaries. (For a review of the structure, activity and industrial applications of these compounds, see, for example, Ullmann's Encyclopedia of Industrial Chemistry, "Vitamins", Vol. A27, pp. 443–613, VCH: Weinheim, 1996). The term "vitamin" is known in the art and comprises nutrients which are required for normal functional of an organism but cannot be synthesized by this organism itself. The group of vitamins may include cofactors and nutraceutical compounds. The term "cofactor" comprises nonproteinaceous compounds necessary for the appearance of a normal enzymic activity. These compounds may be organic or inorganic; the cofactor molecules of the invention are preferably organic. The term "nutraceutical" comprises food additives which are health-promoting in plants and animals, especially humans. Examples of such molecules are vitamins, antioxidants and likewise certain lipids (e.g. polyunsaturated fatty acids).

The biosynthesis of these molecules in organisms able to produce them, such as bacteria, has been comprehensively characterized (Ullmann's Encyclopedia of Industrial Chemistry, "Vitamins", Vol. A27, pp. 443–613, VCH: Weinheim, 1996, Michal, G. (1999) Biochemical Pathways: An Atlas of Biochemistry and Molecular Biology, John Wiley & Sons; Ong, A. S., Niki, E. and Packer, L. (1995) "Nutrition, Lipids, Health and Disease" Proceedings of the UNESCO/Confederation of Scientific and Technological Associations in Malaysia and the Society for free Radical Research—Asia, held on Sep. 1–3, 1994, in Penang, Malaysia, AOCS Press, Champaign, IL X, 374 S).

Thiamine (vitamin $B_1$) is formed by chemical coupling of pyrimidine and thiazole units. Riboflavin (vitamin $B_2$) is synthesized from guanosine 5'-triphosphate (GTP) and ribose 5'-phosphate. Riboflavin in turn is employed for the synthesis of flavin mononucleotide (FMN) and flavin adenine dinucleotide (FAD). The family of compounds together referred to as "vitamin B6" (for example pyridoxine, pyridoxamine, pyridoxal 5'-phosphate and the commercially used pyridoxine hydrochloride), are all derivatives of the common structural unit 5-hydroxy-6-methylpyridine. Panthothenate (pantothenic acid, R-(+)—N-(2,4-dihydroxy-3,3-dimethyl-1-oxobutyl)-β-alanine) can be prepared either by chemical synthesis or by fermentation. The last steps in pantothenate biosynthesis consist of ATP-driven condensation of β-alanine and pantoic acid. The enzymes responsible for the biosynthetic steps for the conversion into pantoic acid and into β-alanine and for the condensation to pantothenic acid are known. The metabolically active form of pantothenate is coenzyme A whose biosynthesis takes place by 5 enzymatic steps. Pantothenate, pyridoxal 5'-phosphate, cysteine and ATP are the precursors of coenzyme A. These enzymes catalyze not only the formation of pantothenate but also the production of (R)-pantoic acid, (R)-pantolactone, (R)-panthenol (provitamin $B_5$), pantetheine (and its derivatives) and coenzyme A.

The biosynthesis of biotin from the precursor molecule pimeloyl-CoA in microorganisms has been investigated in detail, and several of the genes involved have been identified. It has emerged that many of the corresponding proteins are involved in the Fe cluster synthesis and belong to the class of nifS proteins. Liponic acid is derived from octanoic acid and serves as coenzyme in energy metabolism where it is a constituent of the pyruvate dehydrogenase complex and of the α-ketoglutarate dehydrogenase complex. Folates are a group of substances all derived from folic acid which in turn is derived from L-glutamic acid, p-aminobenzoic acid and 6-methylpterin. The biosynthesis of folic acid and its derivatives starting from the intermediate products of the biotransformation of guanosine 5'-triphosphate (GTP), L-glutamic acid and p-aminobenzoic acid has-been investigated in detail in certain microorganisms.

Corrinoids (such as the cobalamines and, in particular, vitamin $B_{12}$) and the porphyrins belong to a group of chemicals distinguished by a tetrapyrrole ring system. The biosynthesis of vitamin $B_{12}$ is so complex that it has not yet been completely characterized, but many of the enzymes and substrates involved are now known. Nicotinic acid (nicotinate) and nicotinamide are pyridine derivatives which are also referred to as "niacin". Niacin is the precursor of the important coenzymes NAD (nicotinamide adenine dinucleotide) and NADP (nicotinamide adenine dinucleotide phosphate) and their reduced forms.

Production of these compounds on the industrial scale is mostly based on cell-free chemical syntheses, although some of these chemicals, such as riboflavin, vitamin $B_6$, pantothenate and biotin, have also been produced by large-scale cultivation of microorganisms. Only vitamin $B_{12}$ is, because of the complexity of its synthesis, produced only by fermentation. In vitro processes require a considerable expenditure of materials and time and frequently high costs.

C. Purine, Pyrimidine, Nucleoside and Nucleotide Metabolism and Uses

Genes for purine and pyrimidine metabolism and their corresponding proteins are important aims for the therapy of oncoses and viral infections. The term "purine" or "pyrimidine" comprises nitrogen-containing bases which form part of nucleic acids, coenzymes and nucleotides. The term "nucleotide" encompasses the fundamental structural units of nucleic acid molecules, which comprise a nitrogen-containing base, a pentose sugar (the sugar is ribose in the case of RNA and the sugar is D-deoxyribose in the case of DNA) and phosphoric acid. The term "nucleoside" comprises molecules which serve as precursors of nucleotides but have, in contrast to the nucleotides, no phosphoric acid unit. It is possible to inhibit RNA and DNA synthesis by inhibiting the biosynthesis of these molecules or their mobilization to form nucleic acid molecules; targeted inhibition of this activity in cancer cells allows the ability of tumor cells to divide and replicate to be inhibited. There are also nucleotides which do not form nucleic acid molecules but serve as energy stores (i.e. AMP) or as coenzymes (i.e. FAD and NAD).

Several publications have described the use of these chemicals for these medical indications, the purine and/or pyrimidine metabolism being influenced (for example Christopherson, R. I. and Lyons, S. D. (1990) "Potent inhibitors of de novo pyrimidine and purine biosynthesis as chemotherapeutic agents", Med. Res. Reviews 10: 505–548). Investigations of enzymes involved in purine and pyrimidine metabolism have concentrated on the development of novel medicaments which can be used, for example, as immunosuppressants or antiproliferative agents (Smith, J. L. (1995) "Enzymes in Nucleotide Synthesis" Curr. Opin. Struct. Biol. 5: 752–757; Simmonds, H. A. (1995) Biochem. Soc. Transact. 23: 877–902). However, purine and pyrimidine bases, nucleosides and nucleotides also have other possible uses: as intermediate products in the biosynthesis of various fine chemicals (e.g. thiamine, S-adenosylmethionine, folates or riboflavin), as energy carriers for the cell (for example ATP or GTP) and for chemicals themselves, which are ordinarily used as flavor enhancers (for example IMP or GMP) or for many medical applications (see, for example, Kuninaka, A., (1996) "Nucleotides and Related Compounds in Biotechnology" Vol. 6, Rehm et al., editors VCH: Weinheim, pp. 561–612). Enzymes involved in purine, pyrimidine, nucleoside or nucleotide metabolism are also increasingly serving as targets against which chemicals are being developed for crop protection, including fungicides, herbicides and insecticides.

The metabolism of these compounds in bacteria has been characterized (for reviews, see, for example, Zalkin, H. and Dixon, J. E. (1992) "De novo purine nucleotide biosynthesis" in Progress in Nucleic Acids Research and Molecular biology, Vol. 42, Academic Press, pp. 259–287; and Michal, G. (1999) "Nucleotides and Nucleosides"; Chapter 8 in: Biochemical Pathways: An Atlas of Biochemistry and Molecular Biology, Wiley, New York). Purine metabolism, the object of intensive research, is essential for normal functioning of the cell. Disordered purine metabolism in higher animals may cause severe illnesses, for example gout. Purine nucleotides are synthesized from ribose 5-phosphate by a number of steps via the intermediate compound inosine 5'-phosphate (IMP), leading to the production of guanosine 5'-monophosphate (GMP) or adenosine 5'-monophosphate (AMP), from which the triphosphate forms used as nucleotides can easily be prepared. These compounds are also used as energy stores, so that breakdown thereof provides energy for many different biochemical processes in the cell. Pyrimidine biosynthesis takes place via formation of uridine 5'-mono-phosphate (UMP) from ribose 5-phosphate. UMP in turn is converted into cytidine 5'-triphosphate (CTP). The deoxy forms of all nucleotides are prepared in a one-step reduction reaction from the diphosphate ribose form of the nucleotide to give the diphosphate deoxyribose form of the nucleotide. After phosphorylation, these molecules can take part in DNA synthesis.

D. Trehalose Metabolism and Uses

Trehalose consists of two glucose molecules linked together by an $\alpha,\alpha$-1,1 linkage. It is ordinarily used in the food industry as sweetener, as additive for dried or frozen foods and in beverages. However, it is also used in the pharmaceutical industry or in the cosmetics industry and biotechnology industry (see, for example, Nishimoto et al., (1998) U.S. Pat. No. 5,759,610; Singer, M. A. and Lindquist, S. (1998) Trends Biotech. 16: 460–467; Paiva, C. L. A. and Panek, A. D. (1996) Biotech Ann. Rev. 2: 293–314; and Shiosaka, M. (1997) J. Japan 172: 97–102). Trehalose is produced by enzymes of many microorganisms and is naturally released into the surrounding medium from which it can be isolated by methods known in the art.

II. Use and Oxidative Phosphorylation of Sugar and Carbon Molecules

Carbon is a crucially important substance for the formation of all organic substances and thus has to be taken in with the nutrition not only for *C. glutamicum* growth and division but also for overproduction of fine chemicals from this microorganism. Sugars such as mono-, di- or polysaccharides are particularly good carbon sources, and standard growth media thus usually contain one or more out of: glucose, fructose, mannose, galactose, ribose, sorbose, ribulose, lactose, maltose, sucrose, raffinose, starch and cellulose (Ullmann's Encyclopedia of Industrial Chemistry (1987) Vol. A9, "Enzymes", VCH: Weinheim). As an alternative, it is possible to use in the media more complex sugar compounds such as molasses or byproducts of sugar refining. In addition to sugars, other compounds may be used as alternative carbon sources, such as, for example, alcohols (e.g. methanol or ethanol), alkanes, sugar alcohols, fatty acids and organic acids (e.g. acetic acid or lactic acid). An overview over carbon sources and their utilization by microorganisms in culture can be found in Ullman's Encyclopedia of Industrial Chemistry (1987) Vol. A9, "Enzymes", VCH: Weinheim; Stoppok, E., and Buchholz, K. (1996) "Sugar-based raw materials for fermentation applications" in Biotechnology (Rehm, H. J., et al., editors.) Vol. 6, VCH: Weinheim, S. 5–29; Rehm, H. J. (1980) Industrielle Mikrobiologie, Springer: Berlin; Batholomew, W. H., and Reiman, H. B. (1979) Economics of Fermentation Processes, in Peppler, H. J., and Perlman, D., editors, Microbial Technology, 2nd edition, Vol. 2, Chapter 18, Academic Press: New York; and Kockova-Kratachvilowa, A. (1981), Vol. 1, Chapter 1, Verlag Chemie: Weinheim.

After being taken up, said energy-rich carbon molecules must be processed so that they can be degraded by one of the main metabolic pathways of sugar. These pathways directly lead to useful degradation products such as ribose 5-phosphate and phosphoenolpyruvate which can then be converted into pyruvate. The three most important pathways of sugar metabolism in bacteria are, inter alia, the Embden-Meyerhoff-Parnas (EMP) pathway (also known as glycolysis or fructose bisphosphate pathway), the hexose monophosphate (HMP) pathway (also known as secondary pentose metabolic pathway or pentosephosphate pathway) and the Entner-Doudoroff (ED) pathway (for a review, see in Michal, G. (1999) Biochemical Pathways: An Atlas of Biochemistry and Molecular Biology, Wiley: New York, and Stryer, L. (1988) Biochemistry, Chapters 13–19, Freeman: New York, and references therein).

The EMP pathway converts hexose molecules into pyruvate, and said process generates 2 ATP molecules and 2 NADH molecules. Starting from glucose 1-phosphate (which is either taken up directly with the medium or, as an alternative, can be generated from glycogen, starch or cellulose), the glucose molecule is isomerized to fructose 6-phosphate, phosphorylated and cleaved into two glyceraldehyde 3-phosphate molecules with 3 carbon atoms each. Dehydrogenation, phosphorylation and subsequent rearrangements result in pyruvate.

The HMP pathway converts glucose into reduction equivalents such as NADH and generates pentose and tetrose compounds which are required as intermediates and precursors in a number of other metabolic pathways. In the HMP pathway, glucose 6-phosphate is converted into ribulose 5-phosphate by two successive dehydrogenase reactions (which also liberate two NADPH molecules) and a carboxylation step. Ribulose 5-phosphate may also be converted into xylulose 5-phosphate and ribose 5-phosphate; in a series of biochemical steps, the former may become glucose 6-phosphate which can enter the EMP pathway, whereas the latter is usually used as intermediate in other biosynthetic pathways in the cell.

The ED pathway starts with the compound glucose or gluconate which is subsequently phosphorylated and dehydrated so as to form 2-dehydro-3-deoxy-6-phosphogluconate. Glucuronate and galacturonate, too, may be converted via more complex biochemical pathways into 2-dehydro-3-deoxy-6-phosphogluconate. This product molecule is then cleaved into glyceraldehyde 3-phosphate and pyruvate; glyceraldehyde 3-phosphate itself may be converted into pyruvate.

The EMP and HMP pathways have many identical features, including intermediates and enzymes. The EMP pathway provides the largest amount of ATP but generates neither ribose 5-phosphate, an important precursor, for example, for nucleic acid biosynthesis, nor erythrose 4-phosphate which is important for amino acid biosynthesis. Microorganisms which can use only the EMP pathway for utilizing glucose are thus unable to grow on simple media with glucose as the sole carbon source. They are referred to as fastidious organisms and their growth requires the supply of complex organic compounds as they are found in yeast extract.

In contrast, the HMP pathway produces all precursors required for nucleic acid and amino acid biosynthesis but provides only half the amount of ATP energy provided by the EMP pathway. The HMP pathway also produces NADPH which can be used for redox reactions in biosynthetic pathways. However, the HMP pathway does not directly generate pyruvate and, consequently, said microorganisms must also possess part of the EMP pathway. It is therefore not surprising that a number of microorganisms have developed during the course of evolution in such a way that they possess both pathways.

The pyruvate molecules generated by said pathways may be converted readily into energy via the Krebs cycle (also known as citric acid cycle, citrate cycle or tricarboxylic acid cycle (TCA cycle)). In this process, pyruvate is first decarboxylated, leading to the production of one NADH molecule, one acetyl-CoA molecule and one $CO_2$ molecule. The acetyl group of acetyl-CoA then reacts with oxaloacetate which comprises 4 carbon atoms, leading to the formation of citric acid, an organic acid with 6 carbon atoms. Finally, oxaloacetate is regenerated and can again serve as acetyl acceptor, thereby completing the cycle. The electrons released during oxidation of intermediates in the TCA cycle are transferred to $NAD^+$, resulting in NADH.

During respiration, the electrons are transferred from NADH to molecular oxygen or other terminal electron acceptors. This process is catalyzed by the respiratory chain, an electron transport system which contains both integral membrane proteins and membrane-associated proteins. This system has two basic tasks: firstly, it accepts electrons from an electron donor and transfers them to an electron acceptor and, secondly, it conserves part of the energy released during electron transfer by synthesizing ATP. It is known that several types of oxidation/reduction enzymes and electron transport proteins are involved in such processes, including NADH dehydrogenases, flavin-containing electron transfer molecules, iron-sulfur proteins and cytochromes. The NADH dehydrogenases are located on the cytosolic surface of the plasma membrane and transfer hydrogen atoms from NADH to flavoproteins which in turn accept electrons from NADH. The flavoproteins are a group of electron transfer molecules which have a prosthetic flavin group which is alternately reduced and oxidized when accepting and transferring electrons. It is known that three flavins take part in these reactions: riboflavin, flavin adenine dinucleotide (FAD) and flavin mononucleotide (FMN). Iron-sulfur proteins contain a cluster of iron and sulfur atoms which are not bound to a heme group but can nevertheless take part in dehydration and rehydration reactions. Succinate dehydrogenase and aconitase are examples of iron-sulfur proteins; their iron-sulfur complexes can accept and transfer electrons as part of the complete electron transport chain. The cytochromes are proteins containing an iron-porphyrin ring (heme). There is a number of different classes of cytochromes which differ in their reduction potentials. Functionally, these cytochromes form pathways in which electrons can be transferred to other cytochromes which have more and more positive reduction potentials. Another class of non-protein electron transfer molecules is known: the lipid-soluble quinones (e.g. coenzyme Q). These molecules also serve as hydrogen acceptors and electron donors.

The action of the respiratory chain generates a proton gradient across the cell membrane, and this causes the proton motive force. This force is utilized by the cell for ATP synthesis via the membrane-spanning enzyme ATP synthase. This enzyme is a multiprotein complex in which the transport of $H^+$ molecules through the membrane leads to physical rotation of the intracellular subunits and to simultaneous phosphorylation of ADP with the formation of ATP (see the overview in Fillingame, R. H., and Divall, S. (1999) Novartis Found Symp. 221:218–229, 229–234).

Non-hexose carbon substrates may likewise serve as carbon and energy source for cells. These substrates may first be converted to hexose sugars in the gluconeogenesis pathway in which glucose is first synthesized by the cell and then degraded in order to generate energy. The starting material for this reaction is phosphoenolpyruvate (PEP), one of the most important intermediates of glycolysis. Rather than from sugars, PEP may also be formed from other substrates such as acetic acid or by decarboxylation of oxaloacetate (which itself is an intermediate of the TCA cycle). Glucose 6-phosphate can be formed by reverse glycolysis (using an enzyme cascade different from that of the original glycolysis). Conversion of pyruvate into glucose requires the use of 6 energy-rich phosphate bonds, whereas glycolysis generates only 2 ATP during conversion of glucose into pyruvate. Complete oxidation of glucose (glycolysis, conversion of pyruvate into acetyl-CoA, citric acid cycle and oxidative phosphorylation) results in 36–38 ATP so that the net loss of energy-rich phosphate bonds during gluconeogenesis compares with an all in all higher gain in said energy-rich molecules generated by the oxidation of glucose.

III. Elements and Methods of the Invention

The present invention is based, at least partially, on the detection of new molecules which are referred to herein as SMP nucleic-acid and SMP-protein molecules and which take part in the conversion of sugars into useful degradation products and energy (e.g. energy) in *C. glutamicum* or which may take part in the production of useful energy-rich molecules (e.g. ATP) by other processes such as oxidative phosphorylation. In one embodiment, the SMP molecules take part in the metabolism of carbon compounds such as sugars or in the generation of energy molecules (e.g. ATP) by processes such as oxidative phosphorylation in *Corynebacterium glutamicum*. In a preferred embodiment, the activity of the inventive SMP molecules of contributing to the carbon metabolism and to energy production in *C. glutamicum* has an effect on the production of a fine chemical of interest by said organism. In a particularly preferred embodiment, the activity of the SMP molecules of the invention is modulated in such a way that the metabolic and energy pathways of *C. glutamicum*, in which the SMP proteins of the invention take part, are modulated with respect to the yield, production and/or efficiency of production, which modulate either directly or indirectly the yield, production and/or efficiency of production of a fine chemical of interest from *C. glutamicum*.

The term "SMP protein" or "SMP polypeptide" comprises proteins which may exert a function in *Corynebacterium glutamicum*, which is involved in the metabolism of carbon compounds such as sugars and in the generation of energy molecules (e.g. ATP) by processes such as oxidative phosphorylation. Examples of SMP proteins comprise those which are encoded by the SMP genes listed in Table 1 and Appendix A. The terms "SMP gene" and "SMP nucleic acid sequence" comprise nucleic acid sequences encoding an SMP protein which comprises a coding region and corresponding untranslated 5' and 3' sequence regions. Examples of SMP genes are those listed in Table 1. The terms "production" and "productivity" are known in the art and include the concentration of the fermentation products (for example of the fine chemical of interest), which is produced within a predetermined time interval and a predetermined fermentation volume (e.g. kg of product per h per 1)). The term "efficiency of production" comprises the time required by the cell for reaching a particular production quantity (for example, the time required by the cell for reaching a particular output rate of a fine chemical). The term "yield" or "product/carbon yield" is known in the art and comprises the efficiency of converting the carbon source into the product (i.e. the fine chemical). This is, for example, usually expressed as kg of product per kg of carbon source. Increasing the yield or production of the compound increases the amount of the molecules obtained or of the suitable obtained molecules of this compound in a particular culture volume over a predetermined period. The terms "biosynthesis" and "biosynthetic pathway" are known in the art and comprise the synthesis of a compound, preferably an organic compound, from intermediates by a cell, for example in a multistep process or highly regulated process. The terms "degradation" and "degradation pathway" are known in the art and comprise cleavage of a compound, preferably an organic compound, into degradation products (in more general terms: smaller or less complex molecules) by a cell, for example in a multistep process or highly regulated process. The term "degradation product" is known in the art and includes degradation products of a compound. These products may themselves be suitable precursors (starting point) or intermediates, which are required for the biosynthesis of other compounds by the cell. The term "metabolism" is known in the art and comprises the entirety of biochemical reactions which take place in an organism. The metabolism of a particular compound (e.g. the metabolism of an amino acid such as glycine) then comprises all biosynthetic, modification and degradation pathways in the cell, which relate to that compound.

In another embodiment, the SMP molecules of the invention are capable of modulating the production of a molecule of interest, such as a fine chemical in a microorganism such as *C. glutamicum*. There is a number of mechanisms by which the modification of an SMP protein of the invention may directly influence the yield, production and/or efficiency of production of a fine chemical from a *C. glutamicum* strain which contains such a modified protein. The degradation of energy-rich carbon molecules such as sugars and the conversion of compounds such as NADH and $FADH_2$ into more useful compounds via oxidative phosphorylation lead to a number of compounds which may themselves be desirable fine chemicals, such as pyruvate, ATP, NADH and a number of sugar intermediates. Furthermore, the energy molecules (such as ATP) and reduction equivalents (such as NADH or NADPH) which are produced by these metabolic pathways are used in the cell for driving reactions which otherwise would be energetically unfavorable. Such unfavorable reactions include many biosynthetic pathways of fine chemicals. By improving the ability of the cell to utilize a particular sugar (e.g. by manipulating the genes involved in the degradation and conversion of said sugar into energy for the cell) it is possible to increase the amount of energy available for unfavorable, yet desired, metabolic reactions (e.g. biosynthesis of a fine chemical of interest) to take place.

The mutagenesis of one or more SMP proteins of the invention may also lead to SMP proteins with altered activities, which influence indirectly the production of one or more fine chemicals of interest from *C. glutamicum*. For example, it is possible, by increasing the efficiency of utilizing one or more sugars (so as to improve conversion of said sugar into utilizable energy molecules) or by increasing the efficiency of converting reduction equivalents into utilizable energy molecules (e.g. by improving the efficiency of oxidative phosphorylation or the activity of ATP synthase), to increase the amount of these energy-rich compounds which is available to the cells for driving metabolic processes which normally are unfavorable. These processes include construction of the cell walls, transcription, translation and the biosynthesis of compounds required for cell growth and cell division (e.g. nucleotides, amino acids, vitamins, lipids, etc.) (Lengeler et al. (1999) Biology of Prokaryotes, Thieme Verlag: Stuttgart, pp. 88–109; 913–918; 875–899). Improving the growth and propagation of these modified cells makes it possible to increase the viability of said cells in large-scale cultures and also to improve their rate of division so that a comparatively larger number of cells can survive in the fermentative culture. The yield, production or efficiency of production may be increased, at least due to the presence of a larger number of viable cells which in each case produce the fine chemical of interest. Many of the degradation compounds and intermediates produced in the sugar metabolism, too, are necessary precursors or intermediates for other biosynthetic pathways in the cell. For example, many amino acids are synthesized directly from compounds which are normally generated from glycolysis or the TCA cycle (for example, serine is synthesized from 3-phosphoglycerate, a glycolysis intermediate). Thus, by increasing the efficiency of converting sugars into useful energy molecules, it is also possible to increase the amount of useful degradation products.

A suitable starting point for preparing the nucleic acid sequences of the invention is the genome of a *Corynebacterium glutamicum* strain which can be obtained from the American Type Culture Collection under the name ATCC 13032.

The nucleic acid sequences of the invention can be prepared from these nucleic acid sequences via the modifications denoted in Table 1, using conventional methods.

An SMP protein of the invention or a biologically active section or fragment thereof may be involved in the metabolism of carbon compounds such as sugars or in the generation of energy molecules (e.g. ATP) by processes such as oxidative phosphorylation in *Corynebacterium glutamicum* or may have one or more of the activities listed in Table 1.

The following subsections describe various aspects of the invention in more detail:

A. Isolated Nucleic Acid Molecules

One aspect of the invention relates to isolated nucleic acid molecules which encode SMP molecules or biologically active sections thereof and to nucleic acid fragments which are sufficient for the use as hybridization probes or primers for identifying or amplifying SMP-encoding nucleic acids (e.g. SMP DNA). The term "nucleic acid molecule", as used herein, is intended to comprise DNA molecules (e.g. cDNA or genomic DNA) and RNA molecules (e.g. mRNA) and also DNA or RNA analogs generated by means of nucleotide analogs. Moreover, this term comprises the untranslated sequence located at the 3' and 5' ends of the coding region of the gene: at least about 100 nucleotides of the sequence upstream of the 5' end of the coding region and at least about 20 nucleotides of the sequence downstream of the 3' end of the coding region of the gene. The nucleic acid molecule may be single-stranded or double-stranded but is preferably double-stranded DNA. An "isolated" nucleic acid molecule is removed from other nucleic acid molecules which are present in the natural source of the nucleic acid. An "isolated" nucleic acid preferably does not have any sequences which flank the nucleic acid naturally in the genomic DNA of the organism from which the nucleic acid originates (for example sequences located at the 5' or 3' end of the nucleic acid). In various embodiments, the isolated SMP nucleic acid molecule may have, for example, less than about 5 kb, 4 kb, 3 kb, 2 kb, 1 kb, 0.5 kb or 0.1 kb of the nucleotide sequences which naturally flank the nucleic acid molecule in the genomic DNA of the cell from which the nucleic acid originates (e.g. a *C. glutamicum* cell). In addition to this, an "isolated" nucleic acid molecule such as a cDNA molecule may be essentially free of another cellular material or culture medium, if prepared by recombinant techniques, or free of chemical precursors or other chemicals, if synthesized chemically.

A nucleic acid molecule of the invention, for example a nucleic acid molecule having a nucleotide sequence of Appendix A or a section thereof, may be prepared by means of molecular biological standard techniques and the sequence information provided here. For example, a *C. glutamicum* SMP cDNA may be isolated from a *C. glutamicum* bank by using a complete sequence from Appendix A or a section thereof as hybridization probe and by using standard hybridization techniques (as described, for example, in Sambrook, J., Fritsch, E. F. and Maniatis, T. Molecular Cloning: A Laboratory Manual. 2nd Ed., Cold Spring Harbor Laboratory, Cold Spring Harbor Laboratory Press, Cold Spring Harbor, N.Y., 1989). Moreover, a nucleic acid molecule comprising a complete sequence from Appendix A or a section thereof can be isolated via polymerase chain reaction, using the oligonucleotide primers produced on the basis of said sequence (for example, it is possible to isolate a nucleic acid molecule comprising a complete sequence from Appendix A or a section thereof via polymerase chain reaction by using oligonucleotide primers which have been produced on the basis of this same sequence of Appendix A). For example, mRNA can be isolated from normal endothelial cells (for example via the guanidinium thiocyanate extraction method of Chirgwin et al. (1979) Biochemistry 18: 5294–5299), and the cDNA can be prepared by means of reverse transcriptase (e.g. Moloney-MLV reverse transcriptase, available from Gibco/BRL, Bethesda, Md., or AMV reverse transcriptase, available from Seikagaku America, Inc., St. Petersburg, Fla.). Synthetic oligonucleotide primers for amplification via polymerase chain reaction can be produced on the basis of any of the nucleotide sequences shown in Appendix A. A nucleic acid of the invention may be amplified by means of cDNA or, alternatively, genomic DNA as template and of suitable oligonucleotide primers according to PCR standard amplification techniques. The nucleic acid amplified in this way may be cloned into a suitable vector and characterized by DNA sequence analysis. Oligonucleotides corresponding to an SMP nucleotide sequence may futhermore be prepared by standard syntheses using, for example, an automatic DNA synthesizer.

In a preferred embodiment, an isolated nucleic acid molecule of the invention comprises one of the nucleotide sequences listed in Appendix A.

In a further preferred embodiment, an isolated nucleic acid molecule of the invention comprises a nucleic acid molecule complementary to any of the nucleotide sequences shown in Appendix A or a section thereof, said nucleic acid molecule being sufficiently complementary to any of the nucleotide sequences shown in Appendix A for it to hybridize with any of the sequences indicated in Appendix A, resulting in a stable duplex.

In one embodiment, the nucleic acid molecule of the invention encodes a protein or a section thereof comprising an amino acid sequence which is sufficiently homologous to an amino acid sequence of Appendix B for the protein or a section thereof to retain the ability to exert a function in

*Corynebacterium glutamicum*, which is involved in the metabolism of carbon compounds such as sugars or in the generation of energy molecules (e.g. ATP) by processes such as oxidative phosphorylation. The term "sufficiently homologous", as used herein, relates to proteins or sections thereof whose amino acid sequences have a minimum number of identical or equivalent amino acid residues (for example an amino acid residue having a side chain similar to that of an amino acid residue in any of the sequences of Appendix B) compared to an amino acid sequence of Appendix B so that the protein or a section thereof is able to exert a function in *Corynebacterium glutamicum*, which is involved in the metabolism of carbon compounds such as sugars or in the generation of energy molecules (e.g. ATP) by processes such as oxidative phosphorylation. Protein components of said sugar metabolic pathways or energy production systems, as described herein, may play a part in the production and secretion of one or more fine chemicals. Examples of these activities are likewise described herein. Thus the "function of an SMP protein" contributes either directly or indirectly to the yield, production and/or efficiency of production of one or more fine chemicals. Table 1 lists examples of SMP protein activities.

Sections of proteins encoded by the SMP nucleic acid molecules of the invention are preferably biologically active sections of any of the SMP proteins. The term "biologically active section of an SMP protein", as used herein, is intended to comprise a section, for example a domain/a motif, of an SMP protein, which is involved in the metabolism of carbon compounds such as sugars or in energy generation pathways in *C. glutamicum* or has an activity indicated in Table 1. In order to determine whether an SMP protein or a biologically active section thereof is able to take part in the transport and metabolism of carbon compounds or in the generation of energy-rich molecules in *C. glutamicum*, an enzyme activity assay may be carried out. These assay methods, as described in detail in example 8 of the examples, are familiar to the skilled worker.

In addition to naturally occurring variants of the SMP sequence, which can exist in the population, the skilled worker likewise is aware of the fact that changes can be introduced into a nucleotide sequence of Appendix A by mutation, leading to a change in the amino acid sequence of the encoded SMP protein, without impairing the functionality of said SMP protein. It is possible, for example, to produce nucleotide substitutions in a sequence of Appendix A, which lead to amino acid substitutions at "nonessential" amino acid residues. A "nonessential" amino acid residue is a residue which can be modified in the wild-type sequence of any of the SMP proteins (Appendix B), without modifying the activity of said SMP protein, whereas an "essential" amino acid residue is required for SMP-protein activity. However, other amino acid residues (for example nonconserved or merely semiconserved amino acid residues in the domain with SMP activity) may not be essential for activity and can therefore probably be modified without modifying said SMP activity.

An isolated nucleic acid molecule encoding an SMP protein which is homologous to a protein sequence of Appendix B may be generated by introducing one or more nucleotide substitutions, additions or deletions into a nucleotide sequence of Appendix A so that one or more amino acid substitutions, additions or deletions are introduced into the encoded protein. The mutations may be introduced into any of the sequences of Appendix A by standard techniques such as site-directed mutagenesis and PCR-mediated mutagenesis. Preference is given to introducing conservative amino acid substitutions at one or more of the predicted nonessential amino acid residues. A "conservative amino acid substitution" replaces the amino acid residue by an amino acid residue with a similar side chain. Families of amino acid residues with similar side chains have been defined in the art. These families comprise amino acids with basic side chains (e.g. lysine, arginine, histidine), acidic side chains (e.g. aspartic acid, glutamic acid), uncharged polar side chains (e.g. glycine, asparagine, glutamine, serine, threonine, tyrosine, cysteine), nonpolar side chains (e.g. alanine, valine, leucine, isoleucine, proline, phenylalanine, methionine, tryptophan), beta-branched side chains (e.g. threonine, valine, isoleucine) and aromatic side chains (e.g. tyrosine, phenylalanine, tryptophan, histidine). A predicted nonessential amino acid residue in an SMP protein is thus preferably replaced by another amino acid residue of the same side-chain family. In a further embodiment, the mutations may alternatively be introduced randomly over the entire or over part of the SMP-encoding sequence, for example by saturation mutagenesis, and the resulting mutants may be tested for an SMP activity described herein in order to identify mutants maintaining SMP activity. After mutagenesis of any of the sequences of Appendix A, the encoded protein may be expressed recombinantly, and the activity of said protein may be determined, for example, using the assays described herein (see example 8 of the examples).

B. Recombinant Expression Vectors and Host Cells

A further aspect of the invention relates to vectors, preferably expression vectors, containing a nucleic acid which encodes an SMP protein (or a section thereof). The term "vector" as used herein, relates to a nucleic acid molecule capable of transporting another nucleic acid to which it is bound. One type of vector is a "plasmid" which term means a circular double-stranded DNA loop into which additional DNA segments can be ligated. Another type of vector is a viral vector, and here additional DNA segments can be ligated into the viral genome. Certain vectors are capable of replicating autonomously in a host cell into which they have been introduced (for example bacterial vectors with bacterial origin of replication and episomal mammalian vectors). Other vectors (e.g. nonepisomal mammalian vectors) are integrated into the genome of a host cell when introduced into said host cell and thereby replicated together with the host genome. Moreover, particular vectors are capable of controlling the expression of genes to which they are functionally linked. These vectors are referred to herein as "expression vectors". Normally, expression vectors which may be used in DNA recombination techniques are in the form of plasmids. In the present description, "plasmid" and "vector" may be used interchangeably, since the plasmid is the most commonly used type of vector. However, the present invention is intended to comprise said other types of expression vectors such as viral vectors (for example replication-deficient retroviruses, adenoviruses and adenovirus-related viruses), which exert similar functions.

The recombinant expression vectors of the invention comprise a nucleic acid of the invention in a form which is suitable for expressing said nucleic acid in a host cell, i.e. the recombinant expression vectors comprise one or more regulatory sequences which are selected on the basis of the host cells to be used for expression and which are functionally linked to the nucleic acid sequence to be expressed. In a recombinant expression vector, the term "functionally linked" means that the nucleotide sequence of interest is bound to the regulatory sequence(s) such that expression of said nucleotide sequence is possible (for example in an in vitro transcription/translation system or in a host cell, if the vector has been introduced into said host cell). The term "regulatory sequence" is intended to comprise promoters, enhancers and other expression control elements (e.g. polyadenylation signals). These regulatory sequences are described, for example, in Goeddel: Gene Expression Technology: Methods in Enzymology 185, Academic Press, San Diego, Calif. (1990). Regulatory sequences comprise those which control constitutive expression of a nucleotide sequence in many types of host cells and those which control direct expression of the nucleotide sequence only in particular host cells. The skilled worker understands that designing an expression vector may depend on factors such as the choice of host cell to be transformed, the desired extent of protein expression, etc. The expression vectors of the invention may be introduced into the host cells so as to prepare proteins or peptides, including the fusion proteins or fusion peptides, which are encoded by the nucleic acids as described herein (e.g. SMP proteins, mutated forms of SMP proteins, fusion proteins, etc.).

The recombinant expression vectors of the invention may be designed for expressing SMP proteins in prokaryotic or eukaryotic cells. For example, SMP genes may be expressed in bacterial cells such as *C. glutamicum*, insect cells (using baculovirus expression vectors), yeast cells and other fungal cells (see Romanos, M. A. et al. (1992) "Foreign gene expression in yeast: a review", Yeast 8: 423–488; van den Hondel, C. A. M. J. J. et al. (1991) "Heterologous gene expression in filamentous fungi" in: More Gene Manipulations in Fungi, J. W. Bennet & L. L. Lasure, Editors, pp. 396–428: Academic Press: San Diego; and van den Hondel, C. A. M. J. J. & Punt, P. J. (1991) "Gene transfer systems and vector development for filamentous fungi in: Applied Molecular Genetics of Fungi, Peberdy, J. F. et al., Editors, pp. 1–28, Cambridge University Press: Cambridge), algal cells and cells of multicellular plants (see Schmidt, R. and Willmitzer, L. (1988) "High efficiency *Agrobacterium tumefaciens*-mediated transformation of *Arabidopsis thaliana* leaf and cotyledon explants" Plant Cell Rep.: 583–586) or mammalian cells. Suitable host cells are further discussed in Goeddel, Gene Expression Technology: Methods in Enzymology 185, Academic Press, San Diego, Calif. (1990). As an alternative, the recombinant expression vector may be transcribed and translated in vitro, for example by using regulatory sequences of the T7 promoter and T7 polymerase.

Proteins are expressed in prokaryotes mainly by using vectors containing constitutive or inducible promoters which control expression of fusion or nonfusion proteins. Fusion vectors contribute a number of amino acids to a protein encoded therein, usually at the amino terminus of the recombinant protein, but also at the C terminus or fused within suitable regions of the proteins. These fusion vectors usually have three tasks: 1) enhancing the expression of recombinant protein; 2) increasing the solubility of the recombinant protein; and 3) supporting the purification of the recombinant protein by acting as a ligand in affinity purification. Often a proteolytic cleavage site is introduced into fusion expression vectors at the junction of fusion unit and recombinant protein so that the recombinant protein can be separated from the fusion unit after purifying the fusion protein. These enzymes and their corresponding recognition sequences comprise factor Xa, thrombin and enterokinase.

Common fusion expression vectors comprise pGEX (Pharmacia Biotech Inc; Smith, D. B. and Johnson, K. S. (1988) Gene 67: 31–40), pMAL (New England Biolabs, Beverly, Mass.) und pRIT 5 (Pharmacia, Piscataway, N.J.), in which glutathione S-transferase (GST), maltose E-binding protein and protein A, respectively, are fused to the recombinant target protein. In one embodiment, the coding sequence of the SMP protein is cloned into a pGEX expression vector such that a vector is generated, which encodes a fusion protein comprising, from N terminus to C terminus: GST—thrombin cleavage site—protein X. The fusion protein may be purified via affinity chromatography by means of a glutathione-agarose resin. The recombinant SMP protein which is not fused to GST may be obtained by cleaving the fusion protein with thrombin.

Examples of suitable inducible nonfusion *E. coli* expression vectors include pTrc (Amann et al., (1988) Gene 69: 301–315) and pET 11d (Studier et al. Gene Expression Technology: Methods in Enzymology 185, Academic Press, San Diego, Calif. (1990) 60–89). The target gene expression from the pTrc vector is based on transcription from a hybrid trp-lac fusion promoter by host RNA polymerase. The target gene expression from the pET 11d vector is based on transcription from a T7-gn10-lac fusion promoter, which is mediated by a coexpressed viral RNA polymerase (T7 gn1). This viral polymerase is provided in the BL 21 (DE3) or HMS174 (DE3) host strain by a resident λ prophage which harbors a T7 gn1 gene under the transcriptional control of the lacUV 5 promoter.

One strategy for maximizing expression of the recombinant protein is to express said protein in a host bacterium whose ability to proteolytically cleave said recombinant protein is disrupted (Gottesman, S. Gene Expression Technology: Methods in Enzymology 185, Academic Press, San Diego, Calif. (1990) 119–128). Another strategy is to modify the nucleic acid sequence of the nucleic acid to be inserted into an expression vector such that the individual codons for each amino acid are those which are preferably used in a bacterium selected for expression, such as *C. glutamicum* (Wada et al. (1992) Nucleic Acids Res. 20: 2111–2118). This modification of the nucleic acid sequences of the invention may be carried out by standard techniques of DNA synthesis.

In a further embodiment, the SMP-protein expression vector is a yeast expression vector. Examples of vectors for expression in the yeast *S. cerevisiae* include pYepSec1 (Baldari et al., (1987) Embo J. 6: 229–234), pMFa (Kurjan and Herskowitz (1982) Cell 30: 933–943), pJRY88 (Schultz et al. (1987) Gene 54: 113–123) and pYES2 (Invitrogen Corporation, San Diego, Calif.). Vectors and methods for constructing vectors which are suitable for use in other fungi such as filamentous fungi include those which are described in detail in: van den Hondel, C. A. M. J. J. & Punt, P. J. (1991) "Gene transfer systems and vector development for filamentous fungi, in: Applied Molecular Genetics of fungi, J. F. Peberdy et al., Editors, pp. 1–28, Cambridge University Press: Cambridge.

As another alternative, it is possible to express the SMP proteins of the invention in insect cells using baculovirus expression vectors. Baculovirus vectors available for expression of proteins in cultured insect cells (e.g. Sf9 cells) include the pAc series (Smith et al., (1983) Mol. Cell Biol. 3: 2156–2165) and the pVL series (Lucklow and Summers (1989) Virology 170: 31–39).

In a further embodiment, the SMP proteins of the invention may be expressed in cells of unicellular plants (such as algae) or in cells of the higher plants (e.g. spermatophytes such as crops). Examples of expression vectors of plants include those which are described in detail in: Bekker, D., Kemper, E., Schell, J. and Masterson, R. (1992) "New plant binary vectors with selectable markers located proximal to the left border", Plant Mol. Biol. 20: 1195–1197; and Bevan, M. W. (1984) "Binary *Agrobacterium* vectors for plant transformation", Nucl. Acids Res. 12: 8711–8721.

A further embodiment, a nucleic acid of the invention is expressed in mammalian cells using a mammalian expression vector. Examples of mammalian expression vectors include pCDM8 (Seed, B. (1987) Nature 329:840) and pMT2PC (Kaufman et al. (1987) EMBO J. 6: 187–195). When used in mammalian cells, the control functions of the expression vector are often provided by viral regulatory elements. Commonly used promoters are derived, for example, from polyoma, adenovirus 2, cytomegalovirus and simian virus 40. Other suitable expression systems for prokaryotic and eukaryotic cells can be found in chapters 16 and 17 of Sambrook, J., Fritsch, E. F. and Maniatis, T., Molecular cloning: A Laboratory Manual, 2nd Edition, Cold Spring Harbor Laboratory, Cold Spring Harbor Laboratory Press, Cold Spring Harbor, N.Y., 1989.

In a further embodiment, the recombinant mammalian expression vector may preferably cause expression of the nucleic acid in a particular cell type (for example, tissue-specific regulatory elements are used for expressing the nucleic acid). Tissue-specific regulatory elements are known in the art. Non-limiting examples of suitable tissue-specific promoters include the albumin promoter (liver-specific; Pinkert et al. (1987) Genes Dev. 1: 268–277), lymphoid-specific promoters (Calame und Eaton (1988) Adv. Immunol. 43: 235–275), in particular promoters of T-cell receptors (Winoto and Baltimore (1989) EMBO J. 8: 729–733) and immunoglobulins (Banerji et al. (1983) Cell 33: 729–740; Queen and Baltimore (1983) Cell 33: 741–748), neuron-specific promoters (e.g. the neurofilament promoter; Byrne and Ruddle (1989) PNAS 86: 5473–5477), pancreas-specific promoters (Edlund et al., (1985) Science 230: 912–916) and mamma-specific promoters (e.g. milk serum promoter; U.S. Pat. No. 4,873,316 and European Patent Application document No. 264 166). Development-regulated promoters for example the murine hox promoters (Kessel and Gruss (1990) Science 249: 374–379) and the α-fetoprotein promoter (Campes and Tilghman (1989) Genes Dev. 3: 537–546), are likewise included.

Moreover, the invention provides a recombinant expression vector comprising an inventive DNA molecule which has been cloned into the expression vector in antisense direction. This means that the DNA molecule is functionally linked to a regulator sequence such that an RNA molecule which is antisense to SMP mRNA can be expressed (via transcription of the DNA molecule). It is possible to select regulatory sequences which are functionally bound to a nucleic acid cloned in antisense direction and which control continuous expression of the antisense RNA molecule in a multiplicity of cell types; for example, it is possible to select viral promoters and/or enhancers or regulatory sequences which control the constitutive tissue-specific or cell type-specific expression of antisense RNA. The antisense expression vector may be in the form of a recombinant plasmid, phagemid or attenuated virus and produces antisense nucleic acids under the control of a highly effective regulatory region whose activity is determined by the cell type into which the vector is introduced. The regulation of gene expression by means of antisense genes is discussed in Weintraub, H. et al., Antisense-RNA as a molecular tool for genetic analysis, Reviews—Trends in Genetics, Vol. 1(1) 1986.

A further aspect of the invention relates to the host cells into which a recombinant expression vector of the invention has been introduced. The terms "host cell" and "recombinant host cell" are used interchangeably herein. Naturally, these terms relate not only to a particular target cell but also to the progeny or potential progeny of this cell. Since particular modifications may appear in successive generations, due to mutation or environmental factors, this progeny is not necessarily identical to the parental cell but is still included within the scope of the term as used herein.

A host cell may be a prokaryotic or eukaryotic cell. For example, an SMP protein may be expressed in bacterial cells such as *C. glutamicum*, insect cells, yeast cells or mammalian cells (such as Chinese hamster ovary (CHO) cells or COS cells). Other suitable host cells are familiar to the skilled worker. Microorganisms which are related to *Corynebacterium glutamicum* and can be used in a suitable manner as host cells for the nucleic acid and protein molecules of the invention are listed in Table 3.

Conventional transformation or transfection methods can be used to introduce vector DNA into prokaryotic or eukaryotic cells. The terms "transformation" and "transfection", "conjugation" and "transduction", as used herein, are intended to comprise a multiplicity of methods known in the art for introducing foreign nucleic acid (e.g. DNA) into a host cell, including calcium phosphate or calcium chloride coprecipitation, DEAE dextran-mediated transfection, lipofection or electroporation. Suitable methods for transformation or transfection of host cells can be found in Sambrook et al. (Molecular Cloning: A Laboratory Manual. 2nd Edition, Cold Spring Harbor Laboratory, Cold Spring Harbor Laboratory Press, Cold Spring Harbor, N.Y., 1989) and other laboratory manuals.

In the case of stable transfection of mammalian cells, it is known that, depending on the expression vector used and transfection technique used, only a small proportion of the cells may integrate the foreign DNA into their genome. These integrants are usually identified and selected by introducing a gene which encodes a selectable marker (e.g. resistant to antibiotics) together with the gene of interest into the host cells. Preferred selectable markers include those which impart resistance to drugs such as G418, hygromycin and methotrexate. A nucleic acid which encodes a selectable marker may be introduced into a host cell on the same vector that encodes an SMP protein or may be introduced in a separate vector. Cells which have been stably transfected with the introduced nucleic acid may, for example, be identified by drug selection (for example, cells which have integrated the selectable marker survive, whereas the other cells die).

A homologous recombined microorganism is generated by preparing a vector which contains at least one SMP-gene section into which a deletion, addition or substitution has been introduced in order to modify, for example functionally disrupt, the SMP gene. Said SMP gene is preferably a *Corynebacterium glutamicum* SMP gene, but it is also possible to use a homolog from a related bacterium or even from a mammalian, yeast or insect source. In a preferred embodiment, the vector is designed such that homologous recombination functionally disrupts the endogenous SMP gene (i.e., the gene no longer encodes a functional protein; also referred to as "knockout" vector). As an alternative, the vector may be designed such that homologous recombination mutates or otherwise modifies the endogenous SMP gene which, however, still encodes the functional protein (for example, the regulatory region located upstream may be modified such that thereby expression of the endogenous SMP protein is modified.). The modified SMP-gene fraction in the homologous recombination vector is flanked at its 5' and 3' ends by additional nucleic acids of the SMP gene, which makes possible a homologous recombination between the exogenous SMP gene carried by the vector and an endogenous SMP gene in a microorganism. The length of the additional flanking SMP nucleic acid is sufficient for a successful homologous recombination with the endogenous gene. Usually, the vector contains several kilobases of flanking DNA (both at the 5' and the 3' ends) (see, for example, Thomas, K. R. and Capecchi, M. R. (1987) Cell 51: 503, for a description of homologous recombination vectors). The vector is introduced into a microorganism (e.g. by electroporation) and cells in which the introduced SMP gene has homologously recombined with the endogenous SMP gene are selected using methods known in the art.

In another embodiment, it is possible to produce recombinant microorganisms which contain selected systems which make possible a regulated expression of the introduced gene. The insertion of an SMP gene into a vector puts it under the control of the lac operon and enables, for example, SMP-gene expression only in the presence of IPTG. These regulatory systems are known in the art.

A host cell of the invention, such as a prokaryotic or eukaryotic host cell in culture, may be used for producing (i.e. expressing) an SMP protein. Moreover, the invention provides methods for producing SMP proteins by using the host cells of the invention. In one embodiment, the method comprises the cultivation of the host cell of the invention (into which a recombinant expression vector encoding an SMP protein has been introduced or in whose genome a gene encoding a wild-type or modified SMP protein has been introduced) in a suitable medium until the SMP protein has been produced. In a further embodiment, the method comprises isolating the SMP proteins from the medium or the host cell.

C. Uses and Methods of the Invention

The nucleic acid molecules, proteins, protein homologs, fusion proteins, primers, vectors and host cells described herein may be used in one or more of the following methods: identification of *C. glutamicum* and related organisms, mapping of genomes of organisms related to *C. glutamicum*, identification and localization of *C. glutamicum* sequences of interest, evolutionary studies, determination of SMP-protein regions required for function, modulation of the activity of an SMP protein; modulation of the metabolism of one or more sugars; modulation of the production of energy-rich molecules in a cell (i.e. of ATP, NADPH) and modulation of the cellular production of a compound of interest, such as a fine chemical. The SMP nucleic acid molecules of the invention have a multiplicity of uses. First, they may be used for identifying an organism as *Corynebacterium glutamicum* or close relatives thereof. They may also be used for identifying the presence of *C. glutamicum* or a relative thereof in a mixed population of microorganisms. The invention provides the nucleic acid sequences of a number of *C. glutamicum* genes. Probing the extracted genomic DNA of a culture of a uniform or mixed population of microorganisms under stringent conditions with a probe which spans a region of a *C. glutamicum* gene which is unique for this organism makes it possible to determine whether said organism is present. Although *Corynebacterium glutamicum* itself is nonpathogenic, it is related to pathogenic species such as *Corynebacterium diphtheriae*. The detection of such an organism is of substantial clinical importance.

The nucleic acid and protein molecules of the invention may furthermore serve as markers for specific regions of the genome. This is useful not only for mapping the genome but also for functional studies of *C. glutamicum* proteins. The genomic region to which a particular *C. glutamicum* DNA-binding protein binds may be identified by cleaving the *C. glutamicum* genome and incubating the fragments with the DNA-binding protein. Those fragments which bind the protein may additionally be probed with the nucleic acid molecules of the invention, preferably by using ready detectable labels; binding of such a nucleic acid molecule to the genomic fragment makes it possible to locate the fragment on the map of the *C. glutamicum* genome, and, when carrying out the process several times using different enzymes, facilitates rapid determination of the nucleic acid sequence to which the protein binds. Moreover, the nucleic acid molecules of the invention may be sufficiently homologous to the sequences of related species for these nucleic acid molecules to serve as markers for constructing a genomic map in related bacteria such as *Brevibacterium lactofermentum*.

The SMP nucleic acid molecules of the invention are likewise suitable for evolutionary studies and protein structure studies. The metabolic and energy release processes in which the molecules of the invention are involved are utilized by a multiplicity of prokaryotic and eukaryotic cells; comparison of the sequences of the nucleic acid molecules of the invention with those encoding similar enzymes of other organisms makes it possible to determine the degree of evolutionary relationship of said organisms. Correspondingly, such a comparison makes it possible to determine which sequence regions are conserved and which are not, and this can be helpful in determining those regions of the protein, which are essential for enzyme function. This type of determination is valuable for protein engineering studies and may give an indication as to how much mutagenesis the protein can tolerate without losing its function.

Manipulation of the SMP nucleic acid molecules of the invention may cause the production of SMP proteins with functional differences to wild-type SMP proteins. These proteins may be improved with respect to their efficiency or activity, may be present in the cell in larger amounts than normal or may be weakened with respect to their efficiency or activity.

There is a number of mechanisms by which the modification of an SMP protein of the invention may directly influence the yield, production and/or efficiency of production of a fine chemical from a *C. glutamicum* strain which contains such a modified protein. The degradation of energy-rich carbon molecules such as sugars and the conversion of compounds such as NADH and $FADH_2$ into more useful compounds via oxidative phosphorylation lead to a number of compounds which may themselves be desirable fine chemicals, such as pyruvate, ATP, NADH and a number of sugar intermediates. Furthermore, the energy molecules (such as ATP) and reduction equivalents (such as NADH or NADPH) which are produced by these metabolic pathways are used in the cell for driving reactions which otherwise would be energetically unfavorable. Such unfavorable reactions include many biosynthetic pathways of fine chemicals. By improving the ability of the cell to utilize a particular sugar (e.g. by manipulating the genes involved in the degradation and conversion of said sugar into energy for the cell) it is possible to increase the amount of energy available for unfavorable, yet desired, metabolic reactions (e.g. biosynthesis of a fine chemical of interest) to take place.

Furthermore, the modulation of one or more pathways involved in the utilization of sugars enables optimization of the conversion of the energy contained in the sugar molecule for producing one or more fine chemicals. For example, a reduction in the activity of enzymes which are involved, for example, in gluconeogenesis results in greater availability of ATP in the cell for driving biochemical reactions of interest (such as the biosynthesis of fine chemicals). It is also possible to modulate the overall production of energy molecules from sugars so as to ensure that the cell maximizes its energy production from each sugar molecule. Inefficient utilization of sugars may lead to excessive $CO_2$ production and excessive energy which may lead to idle metabolic cycles. Improving the metabolism of sugar molecules should enable the cell to work more efficiently and to use fewer carbon molecules. This should lead to an improved fine-chemical product:sugar molecule ratio (improved carbon yield) and makes it possible to reduce the amount of sugars which have to be added to the medium in a large-scale fermentative culture of *C. glutamicum* modified in this way.

The mutagenesis of one or more SMP proteins of the invention may also lead to SMP proteins with altered activities, which influence indirectly the production of one or more-fine chemicals of interest from *C. glutamicum*. For example, it is possible, by increasing the efficiency of utilizing one or more sugars (so as to improve conversion of said sugar into utilizable energy molecules) or by increasing the efficiency of converting reduction equivalents into utilizable energy molecules (e.g. by improving the efficiency of oxidative phosphorylation or the activity of ATP synthase), to increase the amount of these energy-rich compounds which is available to the cells for driving metabolic processes which normally are unfavorable. These processes include construction of the cell walls, transcription, translation and the biosynthesis of compounds required for cell growth and cell division (e.g. nucleotides, amino acids, vitamins, lipids, etc.) (Lengeler et al. (1999) Biology of Prokaryotes, Thieme Verlag: Stuttgart, pp. 88–109; 913–918; 875–899). Improving the growth and propagation of these modified cells makes it possible to increase the viability of said cells in large-scale cultures and also to improve their rate of division so that a comparatively larger number of cells can survive in the fermentative culture. The yield, production or efficiency of production may be increased, at least due to the presence of a larger number of viable cells which in each case produce the fine chemical of interest.

Furthermore, many of the degradation products produced during sugar metabolism are themselves used by the cell as precursors or intermediates for forming a number of other useful compounds, some of which are themselves fine chemicals. For example, pyruvate is converted into the amino acid alanine and ribose 5-phosphate is an integral component of, for example, nucleotide molecules. The extent and efficiency of the sugar metabolism then has a fundamental effect on the availability of these degradation products in the cell. Increasing the ability of the cell to process sugars, either via the efficiency of existing pathways (for example by modifying enzymes involved in these pathways so as to optimize their activity) or by increasing the availability of the enzymes involved in said pathways (for example by increasing the number of enzymes present in the cell), makes it possible to increase the availability of said degradation products in the cell, and this in turn should increase the production of a large variety of other desirable compounds in the cell (e.g. fine chemicals).

These abovementioned strategies for the mutagenesis of SMP proteins, which ought to increase the yields of a fine chemical in *C. glutamicum*, are not intended to be limiting; variations of these mutagenesis strategies are quite obvious to the skilled worker. By using these strategies and including the mechanisms disclosed herein, it is possible to use the nucleic acid and protein molecules of the invention in order to generate *C. glutamicum* or related bacterial strains expressing mutated SMP nucleic acids and protein molecules so as to improve the yield, production and/or efficiency of production of a compound of interest. The compound of interest may be any product produced from *C. glutamicum* including the end products of the biosynthetic pathways and intermediates of naturally occurring metabolic pathways and also molecules which do not naturally occur in the *C. glutamicum* metabolism but are produced by a *C. glutamicum* strain of the invention.

The following examples which are not to be understood as being limiting further illustrate the present invention. The contents of all references, patent applications, patents and published patent applications cited in this patent application are hereby incorporated by way of reference.

EXAMPLES

Example 1

Preparation of Total Genomic DNA from *Corynebacterium glutamicum* ATCC13032

A *Corynebacterium glutamicum* (ATCC 13032) culture was cultivated with vigorous shaking in BHI medium (Difco) at 30° C. overnight. The cells were harvested by centrifugation, the supernatant was discarded and the cells were resuspended in 5 ml of buffer I (5% of the original culture volume—all volumes stated have been calculated for a culture volume of 100 ml). Composition of buffer I: 140.34 g/l sucrose, 2.46 g/l $MgSO_4.7H_2O$, 10 ml/l $KH_2PO_4$ solution (100 g/l, adjusted to pH 6.7 with KOH), 50 ml/l M12 concentrate (10 g/l $(NH_4)_2SO_4$, 1 g/l NaCl, 2 g/l $MgSO_4.7H_2O$, 0.2 g/l $CaCl_2$, 0.5 g/l yeast extract (Difco), 10 ml/l trace element mixture (200 mg/l $FeSO_4$. $H_2O$, 10 mg/l $ZnSO_4.7H_2O$, 3 mg/l $MnCl_2.4H_2O$, 30 mg/l $H_3BO_3$, 20 mg/l $CoCl_2.6H_2O$, 1 mg/l $NiCl_2.6H_2O$, 3 mg/l $Na_2MoO_4.2H_2O$), 500 mg/l complexing agents (EDTA or citric acid), 100 ml/l vitamin mixture (0.2 ml/l biotin, 0.2 mg/l folic acid, 20 mg/l p-aminobenzoic acid, 20 mg/l riboflavin, 40 mg/l Ca panthothenate, 140 mg/l nicotinic acid, 40 mg/l pyridoxal hydrochloride, 200 mg/l myoinositol). Lysozyme was added to the suspension at a final concentration of 2.5 mg/ml. After incubation at 37° C. for approx. 4 h, the cell wall was degraded and the protoplasts obtained were harvested by centrifugation. The pellet was washed once with 5 ml of buffer I and once with 5 ml of TE buffer (10 mM Tris-HCl, 1 mM EDTA, pH 8). The pellet was resuspended in 4 ml of TE buffer and 0.5 ml of SDS solution (10%) and 0.5 ml of NaCl solution (5 M) were added. After addition of proteinase K at a final concentration of 200 µg/ml, the suspension was incubated at 37° C. for approx. 18 h. The DNA was purified via extraction with phenol, phenol/chloroform/isoamyl alcohol and chloroform/isoamyl alcohol by means of standard methods. The DNA was then precipitated by addition of 1/50 volume of 3 M sodium acetate and 2 volumes of ethanol, subsequent incubation at −20° C. for 30 min and centrifugation at 12 000 rpm in a high-speed centrifuge using an SS34 rotor (Sorvall) for 30 min. The DNA was dissolved in 1 ml of TE buffer containing 20 µg/ml RNase A and dialyzed against 1000 ml of TE buffer at 4° C. for at least 3 h. The buffer was exchanged 3 times during this period. 0.4 ml of 2 M LiCl and 0.8 ml of ethanol were added to 0.4 ml aliquots of the dialyzed DNA solution. After incubation at −20° C. for 30 min, the DNA was collected by centrifugation (13 000 rpm, Biofuge Fresco, Heraeus, Hanau, Germany). The DNA pellet was dissolved in TE buffer. It was possible to use DNA prepared by this method for all purposes, including Southern blotting and constructing genomic libraries.

Example 2

Construction of Genomic *Corynebacterium glutamicum* (ATCC13032) Banks in *Escherichia coli*

Starting from DNA prepared as described in Example 1, cosmid and plasmid banks were prepared according to known and well-established methods (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

It was possible to use any plasmid or cosmid. Particular preference was given to using the plasmids pBR322 (Sutcliffe, J. G. (1979) Proc. Natl. Acad. Sci. USA, 75: 3737–3741); pACYC177 (Change & Cohen (1978) J. Bacteriol. 134: 1141–1156); pBS series plasmids (pBSSK+, pBSSK– and others; Stratagene, LaJolla, USA) or cosmids such as SuperCos1 (Stratagene, LaJolla, USA) or Lorist6 (Gibson, T. J. Rosenthal, A., and Waterson, R. H. (1987) Gene 53: 283–286.

Example 3

DNA Sequencing and Functional Computer Analysis

Genomic banks, as described in Example 2, were used for DNA sequencing according to standard methods, in particular the chain termination method using ABI377 sequencers (see, for example, Fleischman, R. D. et al. (1995) "Whole-genome Random Sequencing and Assembly of *Haemophilus Influenzae* Rd., Science 269; 496–512). Sequencing primers having the following nucleotide sequences were used: 5'-GGAAACAGTATGACCATG-3' oder 5'-GTAAAAC-GACGGCCAGT-3'.

Example 4

In vivo Mutagenesis

In vivo mutagenesis of *Corynebacterium glutamicum* may be carried out by passing a plasmid (or other vector) DNA through *E. coli* or other microorganisms (e.g. *Bacillus* spp. or yeasts such as *Saccharomyces cerevisiae*) which cannot maintain the integrity of their genetic information. Common mutator strains contain mutations in the genes for the DNA repair system (e.g., mutHLS, mutD, mutT, etc., for comparison see Rupp, W. D. (1996) DNA repair mechanisms, in: *Escherichia coli* and *Salmonella*, pp. 2277–2294, ASM: Washington). These strains are known to the skilled worker. The use of these strains is illustrated, for example, in Greener, A. and Callahan, M. (1994) Strategies 7; 32–34.

Example 5

DNA Transfer Between *Escherichia coli* and *Corynebacterium glutamicum*

A plurality of *Corynebacterium* and *Brevibacterium* species contain endogenous plasmids (such as, for example, pHM1519 or pBL1) which replicate autonomously (for a review see, for example, Martin, J. F. et al. (1987) Biotechnology 5: 137–146). Shuttle vectors for *Escherichia coli* and *Corynebacterium glutamicum* can be constructed readily by means of standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), to which an origin of replication for and a suitable marker from *Corynebacterium glutamicum* is added. Such origins of replication are preferably taken from endogenous plasmids which have been isolated from *Corynebacterium* and *Brevibacterium* species. Particularly useful transformation markers for these species are genes for kanamycin resistance (such as those derived from the Tn5 or the Tn903 transposon) or for chloramphenicol resistance (Winnacker, E. L. (1987) "From Genes to Clones—Introduction to Gene Technology, VCH, Weinheim). There are numerous examples in the literature for preparing a large multiplicity of shuttle vectors which are replicated in *E. coli* and *C. glutamicum* and can be used for various purposes, including the overexpression of genes (see, for example, Yoshihama, M. et al. (1985) J. Bacteriol. 162: 591–597, Martin, J. F. et al., (1987) Biotechnology, 5: 137–146 and Eikmanns, B. J. et al. (1992) Gene 102: 93–98).

Standard methods make it possible to clone a gene of interest into one of the above-described shuttle vectors and to introduce such hybrid vectors into *Corynebacterium glutamicum* strains. *C. glutamicum* can be transformed via protoplast transformation (Kastsumata, R. et al., (1984) J. Bacteriol. 159, 306–311), electroporation (Liebl, E. et al., (1989) FEMS Microbiol. Letters, 53: 399–303) and, in cases in which specific vectors are used, also via conjugation (as described, for example, in Schäfer, A., et al. (1990) J. Bacteriol. 172: 1663–1666). Likewise, it is possible to transfer the shuttle vectors for *C. glutamicum* to *E. coli* by preparing plasmid DNA from *C. glutamicum* (by means of standard methods known in the art) and transforming it into *E. coli*. This transformation step can be carried out using standard methods but advantageously an Mcr-deficient *E. coli* strain such as NM522 (Gough & Murray (1983) J. Mol. Biol. 166: 1–19) is used.

Example 6

Determination of the Expression of the Mutant Protein

The observations of the activity of a mutated protein in a transformed host cell are based on the fact that the mutant protein is expressed in a similar manner and in similar quantity to the wild-type protein. A suitable method for determining the amount of transcription of the mutant gene (an indication of the amount of mRNA available for translation of the gene product) is to carry out a Northern blot (see, for example, Ausubel et al., (1988) Current Protocols in Molecular Biology, Wiley: New York), with a primer which is designed such that it binds to the gene of interest being provided with a detectable (usually radioactive or chemiluminescent) label such that—when the total RNA of a culture of the organism is extracted, fractionated on a gel, transferred to a stable matrix and incubated with this probe—binding and binding quantity of the probe indicate the presence and also the amount of mRNA for said gene. This information is an indication of the extent to which the mutant gene has been transcribed. Total cell RNA can be isolated from *Corynebacterium glutamicum* by various methods known in the art, as described in Bormann, E. R. et al., (1992) Mol. Microbiol. 6: 317–326.

The presence or the relative amount of protein translated from said mRNA can be determined by using standard techniques such as Western blot (see, for example, Ausubel et al. (1988) "Current Protocols in Molecular Biology", Wiley, New York). In this method, total cell proteins are extracted, fractionated by gel electrophoresis, transferred to a matrix such as nitrocellulose and incubated with a probe, for example an antibody, which binds specifically to the protein of interest. This probe is usually provided with a chemiluminescent or calorimetric label which can be readily detected. The presence and the observed amount of label indicate the presence and the amount of the desired mutant protein in the cell.

Example 7

Growth of Genetically Modified *Corynebacterium glutamicum*—Media and Cultivation Conditions Genetically modified *corynebacteria* are cultivated in synthetic or natural growth media. A number of different growth media for *corynebacteria* are known and readily available (Lieb et al. (1989) Appl. Microbiol. Biotechnol. 32: 205–210; von der Osten et al. (1998) Biotechnology Letters 11: 11–16; Patent DE 4 120 867; Liebl (1992) "The Genus *Corynebacterium*", in: The Procaryotes, Vol. II, Balows, A., et al., editors Springer-Verlag). These media are composed of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch and cellulose. Sugars may also be added to the media via complex compounds such as molasses or other byproducts from sugar refining. It may also be advantageous to add mixtures of various carbon sources. Other possible carbon sources are alcohols and organic acids, such as methanol, ethanol, acetic acid or lactic acid. Nitrogen sources are usually organic or inorganic nitrogen compounds or materials containing these compounds. Examples of nitrogen sources include ammonia gas and ammonium salts such as $NH_4Cl$ or $(NH_4)_2SO_4$, $NH_4OH$, nitrates, urea, amino acids and complex nitrogen sources such as cornsteep liquor, soya meal, soya protein, yeast extracts, meat extracts and others.

Inorganic salt compounds which may be present in the media include the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechuate and organic acids such as citric acid. The media usually also contain other growth factors such as vitamins or growth promoters, examples of which include biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the media heavily depends on the particular experiment and is decided upon individually for each specific case. Information on the optimization of media can be found in the textbook "Applied Microbiol. Physiology, A Practical Approach" (editors P. M. Rhodes, P. F. Stanbury, IRL Press (1997) pp. 53–73, ISBN 0 19 963577 3). Growth media can also be obtained from commercial suppliers, for example Standard 1 (Merck) or BHI (brain heart infusion, DIFCO) and the like.

All media components are sterilized, either by heat (20 min at 1.5 bar and 121° C.) or by sterile filtration. The components may be sterilized either together or, if required, separately. All media components may be present at the start of the cultivation or added continuously or batchwise, as desired.

The cultivation conditions are defined separately for each experiment. The temperature should be between 15° C. and 45° C. and may be kept constant or may be altered during the experiment. The pH of the medium should be in the range from 5 to 8.5, preferably around 7.0 and may be maintained by adding buffers to the media. An example of a buffer for this purpose is a potassium phosphate buffer. Synthetic buffers such as MOPS, HEPES; ACES, etc. may be used alternatively or simultaneously. Addition of NaOH or $NH_4OH$ can also keep the pH constant during cultivation. If complex media components such as yeast extract are used, the demand for additional buffers decreases, since many complex compounds have a high buffer capacity. In the case of using a fermenter for cultivating microorganisms, the pH may also be regulated using gaseous ammonia.

The incubation period is usually in a range from several hours to several days. This time is selected such that the maximum amount of product accumulates in the broth. The growth experiments disclosed may be carried out in a multiplicity of containers such as microtiter plates, glass tubes, glass flasks or glass or metal fermenters of different sizes. For the screening of a large number of clones, the microorganisms should be grown in microtiter plates, glass tubes or shaker flasks either with or without baffles. Preference is given to using 100 ml shaker flasks which are filled with 10% (based on volume) of the required growth medium. The flasks should be shaken on an orbital shaker (amplitude 25 mm) at a speed in the range of 100–300 rpm. Losses due to evaporation can be reduced by maintaining a humid atmosphere; alternatively, the losses due to evaporation should be corrected mathematically.

If genetically modified clones are investigated, an unmodified control clone or a control clone containing the basic plasmid without insert should also be assayed. The medium is inoculated to an $OD_{600}$ of 0.5–1.5, with cells being used which have been grown on agar plates such as CM plates (10 g/l glucose, 2.5 g/l NaCl, 2 g/l urea, 10 g/l polypeptone, 5 g/l yeast extract, 5 g/l meat extract, 22 g/l agar pH 6.8 with 2 M NaOH) which have been incubated at 30° C. The media are inoculated either by introducing a saline solution of *C. glutamicum* cells from CM plates or by adding a liquid preculture of said bacterium.

Example 8

In vitro Analysis of the Function of Mutant Proteins

The determination of the activities and kinetic parameters of enzymes is well known in the art. Experiments for determining the activity of a particular modified enzyme must be adapted to the specific activity of the wild-type enzyme, and this is within the capabilities of the skilled worker. Overviews regarding enzymes in general and also specific details concerning the structure, kinetics, principles, methods, applications and examples of the determination of many enzyme activities can be found, for example, in the following references: Dixon, M., and Webb, E. C: (1979)

Enzymes, Longmans, London; Fersht (1985) Enzyme Structure and Mechanism, Freeman, New York; Walsh (1979) Enzymatic Reaction Mechanisms. Freeman, San Francisco; Price, N. C., Stevens, L. (1982) Fundamentals of Enzymology. Oxford Univ. Press: Oxford; Boyer, P. D: editors (1983) The Enzymes, 3rd edition, Academic Press, New York; Bisswanger, H. (1994) Enzymkinetik, 2nd edition VCH, Weinheim (ISBN 3527300325); Bergmeyer, H. U., Bergmeyer, J., Graβl, M. editors (1983–1986) Methods of Enzymatic Analysis, 3rd edition, Vol. I-XII, Verlag Chemie: Weinheim; and Ullmann's Encyclopedia of Industrial Chemistry (1987) Vol. A9, "Enzymes", VCH, Weinheim, pp. 352–363.

The activity of proteins binding to DNA can be measured by many well-established methods such as DNA bandshift assays (which are also referred to as gel retardation assays). The action of these proteins on the expression of other molecules can be measured using reporter gene assays (as described in Kolmar, H. et al., (1995) EMBO J. 14: 3895–3904 and in references therein). Reporter gene assay systems are well known and established for applications in prokaryotic and eukaryotic cells, with enzymes such as beta-galactosidase, green fluorescent protein and several other enzymes being used.

The activity of membrane transport proteins can be determined according to techniques described in Gennis, R. B. (1989) "Pores, Channels and Transporters", in Biomembranes, Molecular Structure and Function, Springer: Heidelberg, pp. 85–137; 199–234; and 270–322.

Example 9

Analysis of the Influence of Mutated Protein on the Production of the Product of Interest The effect of the genetic modification in *C. glutamicum* on the production of a compound of interest (such as an amino acid) can be determined by growing the modified microorganisms under suitable conditions (such as those described above) and testing the medium and/or the cellular components with regard to increased production of the product of interest (i.e. an amino acid). Such analytical techniques are well known to the skilled worker and include spectroscopy, thin-layer chromatography, various types of coloring methods, enzymic and microbiological methods and analytical chromatography such as high performance liquid chromatography (see, for example, Ullman, Encyclopedia of Industrial Chemistry, Vol. A2, pp. 89–90 and pp. 443–613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469–714, VCH: Weinheim; Belter, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; Chapter 11, pp. 1–27, VCH: Weinheim; and Dechow, F. J. (1989) Separation and purification techniques in biotechnology, Noyes Publications).

In addition to measuring the end product of the fermentation, it is likewise possible to analyze other components of the metabolic pathways, which are used for producing the compound of interest, such as intermediates and byproducts, in order to determine the overall efficiency of production of the compound. The analytical methods include measuring the amounts of nutrients in the medium (for example sugars, hydrocarbons, nitrogen sources, phosphate and other ions), measuring biomass composition and growth, analyzing the production of common metabolites from biosynthetic pathways and measuring gases generated during fermentation. Standard methods for these measurements are described in Applied Microbial Physiology; A Practical Approach, P. M. Rhodes and P. F. Stanbury, editors IRL Press, pp. 103–129; 131–163 and 165–192 (ISBN: 0199635773) and the references therein.

Example 10

Purification of the Product of Interest from a *C. glutamicum* Culture

The product of interest may be obtained from *C. glutamicum* cells or from the supernatant of the above-described culture by various methods known in the art. If the product of interest is not secreted by the cells, the cells may be harvested from the culture by slow centrifugation, and the cells may be lysed by standard techniques such as mechanial force or sonication. The cell debris is removed by centrifugation and the supernatant fraction which contains the soluble proteins is obtained for further purification of the compound of interest. If the product is secreted by the *C. glutamicum* cells, the cells are removed from the culture by slow centrifugation and the supernatant fraction is retained for further purification.

The supernatant fraction from both purification methods is subjected to chromatography using a suitable resin, and either the molecule of interest is retained on the chromatography resin while many contaminants in the sample are not, or the contaminants remain on the resin while the sample does not. If necessary, these chromatography steps can be repeated using the same or different chromatography resins. The skilled worker is familiar with the selection of suitable chromatography resins and their most effective application for a particular molecule to be purified. The purified product may be concentrated by filtration or ultrafiltration and stored at a temperature at which product stability is highest.

In the art, many purification methods are known and the above purification method is not intended to be limiting. Said purification methods are described, for example, in Bailey, J. E. & Ollis, D. F. Biochemical Engineering Fundamentals, McGraw-Hill: New York (1986).

The identity and purity of the isolated compounds can be determined by techniques of the prior art. These techniques comprise high performance liquid chromatography (HPLC), spectroscopic methods, coloring methods, thin-layer chromatography, NIRS, enzyme assays or microbiological assays.

These analytical methods are compiled in: Patek et al. (1994) Appl. Environ. Microbiol. 60: 133–140; Malakhova et al. (1996) Biotekhnologiya 11: 27–32; and Schmidt et al. (1998) Bioprocess Engineer. 19: 67–70. Ulmann's Encyclopedia of Industrial Chemistry (1996) Vol. A27, VCH: Weinheim, pp. 89–90, pp. 521–540, pp. 540–547, pp. 559–566, 575–581 and pp. 581–587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Equivalents

The skilled worker knows, or can identify by using simply routine methods, a large number of equivalents of the specific embodiments of the invention. These equivalents are intended to be included in the patent claims below.

The information in Table 1 is to be understood as follows:

In column 1, "DNA ID", the relevant number refers in each case to the SEQ ID NO of the enclosed sequence listing. Consequently, "5" in column "DNA ID" is a reference to SEQ ID NO:5.

In column 2, "AA ID", the relevant number refers in each case to the SEQ ID NO of the enclosed sequence listing. Consequently, "6" in column "AA ID" is a reference to SEQ ID NO:6.

In column 3, "Identification", an unambiguous internal name for each sequence is listed.

In column 4, "AA pos", the relevant number refers in each case to the amino acid position of the polypeptide sequence "AA ID" in the same row. Consequently, "26" in column "AA pos" is amino acid position 26 of the polypeptide sequence indicated accordingly. Position counting starts at the N terminus with +1.

In column 5, "AA wild type", the relevant letter refers in each case to the amino acid, displayed in the one-letter code, at the position in the corresponding wild-type strain, which is indicated in column 4.

In column 6, "AA mutant", the relevant letter refers in each case to the amino acid, displayed in the one-letter code, at the position in the corresponding mutant strain, which is indicated in column 4.

In column 7, "Function", the physiological function of the corresponding polypeptide sequence is listed.

One-letter code of the proteinogenic amino acids:

A Alanine
C Cysteine
D Aspartic acid
E Glutamic acid
F Phenylalanine
G Glycine
H Histidine
I Isoleucine
K Lysine
L Leucine
M Methionine
N Asparagine
P Proline
Q Glutamine
R Arginine
S Serine
T Threonine
V Valine
W Tryptophan
Y Tyrosine

TABLE 1

Genes coding for proteins of carbon metabolism and energy production

| DNA ID: | AA ID: | Identification | AA pos: | AA wild type | AA mutant | Function: |
|---|---|---|---|---|---|---|
| 1 | 2 | RXA00149 | 75 | P | S | METHYLMALONYL-COA MUTASE (EC 5.4.99.2) |
| | | | 413 | G | E | METHYLMALONYL-COA MUTASE (EC 5.4.99.2) |
| | | | 417 | A | V | METHYLMALONYL-COA MUTASE (EC 5.4.99.2) |
| 3 | 4 | RXA00196 | 83 | G | E | 1-DEOXY-D-XYLULOSE 5-PHOSPHATE REDUCTOISOMERASE (EC 1.1.1.—) |
| 5 | 6 | RXA00224 | 54 | G | S | ELECTRON TRANSFER FLAVOPROTEIN ALPHA-SUBUNIT |
| 7 | 8 | RXA00235 | 223 | E | K | ENOLASE (EC 4.2.1.11) |
| 9 | 10 | RXA00296 | 918 | C | Y | ANAEROBIC GLYCEROL-3-PHOSPHATE DEHYDROGENASE SUBUNIT C/GLYCOLATE OXIDASE, IRON-SULFUR SUBUNIT |
| 11 | 12 | RXA00389 | 55 | A | T | oxoglutarate semialdehyde dehydrogenase (EC 1.2.1.—) |
| | | | 481 | G | E | oxoglutarate semialdehyde dehydrogenase (EC 1.2.1.—) |
| 13 | 14 | RXA00412 | 346 | G | S | ABC TRANSPORTER ATP-BINDING PROTEIN |
| 15 | 16 | RXA00483 | 387 | G | D | NUCLEOSIDE-DIPHOSPHATE-SUGAR EPIMERASE |
| 17 | 18 | RXA00511 | 23 | A | T | PHOSPHOGLUCOSAMINE MUTASE (EC 5.4.2.—)/PHOSPHOACETYLGLUCOSAMINE MUTASE (EC 5.4.2.3)/PHOSPHOMANNOMUTASE (EC 5.4.2.8) |
| 19 | 20 | RXA00526 | 58 | D | N | ABC TRANSPORTER ATP-BINDING PROTEIN |
| 21 | 22 | RXA00683 | 239 | D | N | PHOSPHOENOLPYRUVATE SYNTHASE (EC 2.7.9.2) |
| 23 | 24 | RXA00684 | 421 | S | F | CYTOCHROME P450 116 (EC 1.14.—.—) |
| 25 | 26 | RXA00783 | 44 | P | S | SUCCINYL-COA SYNTHETASE BETA CHAIN (EC 6.2.1.5) |
| | | | 66 | G | E | SUCCINYL-COA SYNTHETASE BETA CHAIN (EC 6.2.1.5) |
| | | | 192 | A | T | SUCCINYL-COA SYNTHETASE BETA CHAIN (EC 6.2.1.5) |
| 27 | 28 | RXA00825 | 26 | E | K | DTDP-GLUCOSE 4,6-DEHYDRATASE (EC 4.2.1.46) |
| 29 | 30 | RXA00868 | 379 | E | K | IOLD PROTEIN |
| 31 | 32 | RXA00999 | 158 | P | S | 6-PHOSPHOGLUCONATE DEHYDROGENASE, DECARBOXYLATING (EC 1.1.1.44) |
| | | | 361 | S | F | 6-PHOSPHOGLUCONATE DEHYDROGENASE, DECARBOXYLATING (EC 1.1.1.44) |
| 33 | 34 | RXA01017 | 37 | V | I | Hypothetical Cytosolic Protein |
| 35 | 36 | RXA01025 | 264 | G | S | GLYCEROL-3-PHOSPHATE DEHYDROGENASE (NAD(P)+) (EC 1.1.1.94) |
| 37 | 38 | RXA01175 | 25 | G | S | PHOSPHO-2-DEHYDRO-3-DEOXYHEPTONATE ALDOLASE (EC 4.1.2.15) |
| | | | 105 | A | V | PHOSPHO-2-DEHYDRO-3-DEOXYHEPTONATE ALDOLASE (EC 4.1.2.15) |
| | | | 314 | G | D | PHOSPHO-2-DEHYDRO-3-DEOXYHEPTONATE ALDOLASE (EC 4.1.2.15) |
| 39 | 40 | RXA01350 | 313 | T | I | MALATE DEHYDROGENASE (EC 1.1.1.37) |
| 41 | 42 | RXA01392 | 120 | D | T | GLUTATHIONE S-TRANSFERASE (EC 2.5.1.18) |
| | | | 125 | R | P | GLUTATHIONE S-TRANSFERASE (EC 2.5.1.18) |
| | | | 126 | F | L | GLUTATHIONE S-TRANSFERASE (EC 2.5.1.18) |
| | | | 128 | D | R | GLUTATHIONE S-TRANSFERASE (EC 2.5.1.18) |
| | | | 188 | R | C | GLUTATHIONE S-TRANSFERASE (EC 2.5.1.18) |

TABLE 1-continued

Genes coding for proteins of carbon metabolism and energy production

| DNA ID: | AA ID: | Identification | AA pos: | AA wild type | AA mutant | Function: |
|---|---|---|---|---|---|---|
| 43 | 44 | RXA01436 | 342 | D | N | ACETATE KINASE (EC 2.7.2.1) |
| 45 | 46 | RXA01478 | 255 | A | T | GLUCOAMYLASE G1 AND G2 PRECURSOR (EC 3.2.1.3) |
| 47 | 48 | RXA01554 | 124 | G | D | GLUCAN ENDO-1,3-BETA-GLUCOSIDASE A1 PRECURSOR (EC 3.2.1.39) |
|  |  |  | 486 | G | R | GLUCAN ENDO-1,3-BETA-GLUCOSIDASE A1 PRECURSOR (EC 3.2.1.39) |
| 49 | 50 | RXA01562 | 59 | V | I | 1-DEOXYXYLULOSE-5-PHOSPHATE SYNTHASE |
| 51 | 52 | RXA01569 | 383 | G | D | DTDP-4-DEHYDRORHAMNOSE 3,5-EPIMERASE (EC 5.1.3.13)/DTDP-4-DEHYDRORHAMNOSE REDUCTASE (EC 1.1.1.133) |
| 53 | 54 | RXA01693 | 102 | A | T | Hypothetical Cytosolic Protein |
| 55 | 56 | RXA01814 | 53 | S | N | PHOSPHOGLUCOMUTASE (EC 5.4.2.2)/PHOSPHOMANNOMUTASE (EC 5.4.2.8) |
| 57 | 58 | RXA01882 | 109 | L | P | 1-PHOSPHOFRUCTOKINASE (EC 2.7.1.56) |
| 59 | 60 | RXA01887 | 142 | G | D | MYO-INOSITOL 2-DEHYDROGENASE (EC 1.1.1.18) |
| 61 | 62 | RXA02056 | 1059 | P | L | 2-OXOGLUTARATE DEHYOROGENASE E1 COMPONENT (EC 1.2.4.2) |
|  |  |  | 1121 | A | V | 2-OXOGLUTARATE DEHYDROGENASE E1 COMPONENT (EC 1.2.4.2) |
| 63 | 64 | RXA02063 | 137 | G | D | GLUCOSE-1-PHOSPHATE ADENYLYLTRANSFERASE (EC 2.7.7.27) |
| 65 | 66 | RXA02100 | 730 | A | T | GLYCOGEN PHOSPHORYLASE (EC 2.4.1.1) |
| 67 | 68 | RXA02144 | 262 | T | I | MENAQUINOL-CYTOCHROME C REDUCTASE IRON-SULFUR SUBUNIT |
| 69 | 70 | RXA02149 | 213 | A | V | GLUCOKINASE (EC 2.7.1.2) |
| 71 | 72 | RXA02196 | 198 | T | I | PHOSPHOGLYCOLATE PHOSPHATASE (EC 3.1.3.18) |
| 73 | 74 | RXA02206 | 73 | G | D | OXIDOREDUCTASE (EC 1.1.1.—) |
|  |  |  | 114 | A | T | OXIDOREDUCTASE (EC 1.1.1.—) |
|  |  |  | 314 | R | C | OXIDOREDUCTASE (EC 1.1.1.—) |
| 75 | 76 | RXA02399 | 348 | A | T | ISOCITRATE LYASE (EC 4.1.3.1) |
| 77 | 78 | RXA02404 | 51 | E | K | MALATE SYNTHASE (EC 4.1.3.2) |
| 79 | 80 | RXA02414 | 140 | G | S | INTEGRAL MEMBRANE PROTEIN (Rhomboid family) |
| 81 | 82 | RXA02434 | 525 | P | S | TRANSPORTER |
| 83 | 84 | RXA02440 | 41 | T | M | D-RIBOSE-BINDING PERIPLASMIC PROTEIN PRECURSOR |
| 85 | 86 | RXA02474 | 7 | E | K | (S,S)-butane-2,3-diol dehydrogenase (EC 1.1.1.76) |
| 87 | 88 | RXA02480 | 248 | P | S | CYTOCHROME C OXIDASE POLYPEPTIDE I (EC 1.9.3.1) |
| 89 | 90 | RXA02560 | 138 | G | E | OXYGEN-INSENSITIVE NAD(P)H NITROREDUCTASE (EC 1.—.—.—)/DIHYDROPTERIDINE REDUCTASE (EC 1.6.99.7) |
|  |  |  | 192 | P | S | OXYGEN-INSENSITIVE NAD(P)H NITROREDUCTASE (EC 1.—.—.—)/DIHYDROPTERIDINE REDUCTASE (EC 1.6.99.7) |
| 91 | 92 | RXA02591 | 377 | P | S | PHOSPHOENOLPYRUVATE CARBOXYKINASE [GTP] (EC 4.1.1.32) |
| 93 | 94 | RXA02654 | 56 | T | I | GLUCOSE 1-DEHYDROGENASE (EC 1.1.1.47) |
| 95 | 96 | RXA02694 | 74 | A | V | L-LACTATE DEHYDROGENASE (EC 1.1.1.27) |
| 97 | 98 | RXA02735 | 27 | P | S | 6-PHOSPHOGLUCONOLACTONASE (EC 3.1.1.31) |
| 99 | 100 | RXA02739 | 327 | A | T | TRANSKETOLASE (EC 2.2.1.1) |
| 101 | 102 | RXA02740 | 313 | G | D | PROTOHEME IX FARNESYLTRANSFERASE (EC 2.5.1.—) |
| 103 | 104 | RXA03030 | 162 | P | L | PERIPLASMIC BETA-GLUCOSIDASE/BETA-XYLOSIDASE PRECURSOR (EC 3.2.1.21) (EC 3.2.1.37) |
| 105 | 106 | RXA03083 | 351 | A | V | DIHYDROLIPOAMIDE DEHYDROGENASE (EC 1.8.1.4) |
| 107 | 108 | RXA03150 | 223 | G | V | ALDEHYDE DEHYDROGENASE (EC 1.2.1.3) |
| 109 | 110 | RXA03216 | 93 | D | N | IOLE PROTEIN |
| 111 | 112 | RXA03388 | 129 | A | V | UTP-GLUCOSE-1-PHOSPHATE URIDYLYLTRANSFERASE (EC 2.7.7.9) |
| 113 | 114 | RXA04088 | 39 | E | K | ENDO-1,4-BETA-XYLANASE A (EC 3.2.1.8) |
| 115 | 116 | RXA04279 | 480 | R | H | DIHYDROLIPOAMIDE SUCCINYLTRANSFERASE COMPONENT (E2) OF 2-OXOGLUTARATE DEHYDROGENASE COMPLEX (EC 2.3.1.61) |

SEQUENCE LISTING (116 sequences)

SEQ ID NO: 1 - DNA, 1978 bp, Corynebacterium glutamicum
  CDS (101)..(1948): RXA00149
ttttcgtaggtaaacacaggtgaaggctttacaagcttgtgaactccctacacaaaagcaatccaatagctatccataagcaagagaaagtaagtctacgttgactgatctcacaaagactgcggtgcccgaggaactttcagagaacctcgaaacttggtacaaggctgtggccggtgttttcgcgcgcacacagaaaaaagacatcggcgacattgccgtagatgtgtggaagaaactcatcgtcactacaccggatggtgttgatatcaatccgctgtacaccagagcagatgagtcccagaggaaattcactgaggttcctggtgagtttcccttcactaggggaaccactgttgatggtgaacgcgttggttggggtgttactgagactttcggacatgacagcccgaagaatatcaacgctgcggtgctgaatgctctgaattctggcaccaccacattgggttttgagttctctgaggaattcacggcagctgatcttaaagttgctctcgaaggcgtgtatctcaacatggctccgttgctgattcatgcgggtggatccacgtcagaggttgcagcggcgttgtatacgttggcggaggaagccggaacgttttttgctgcgttgaccttgggttctcgtcctttgacggcgcaggttgatggttcgcacagtgacaccattgaagaagcagttcagttggcagtgaatgcttccaagcgtgcgaatgtgcgcgctatcttggtggatggttccagtttttccaaccagggcgcgtcggatgctcaagaaattggtctaagtatcgccgccggtgtggattatgtccgtcgcttggtcgatgcaggcctttccacggaagctgcacttaagcaggtggcgttccgttttgcggtcaccgatgagcagttcgcgcagatttctaagctgcgtgtggctcgacgtctgtgggccagggtgtgtgaggtgcttggttttccagagctggccgtagcaccacagcatgcggtgactgcacgagcgatgtttagccagcgtgatccgtgggtgaatatgctgcgcagtactgttgcagctttcgctgcaggcgtcggtggagcaaccgatgtggaggttcgtacttttgatgatgcgatcccagatggagttcctggagtgtcgaggaatttcgctcaccgcatcgcgcgcaatactaatttgttgttgctagaagagtcacatcttggtcacgtggttgatcctgctggtggatcatatttcgtggagagcttcaccgatgatctagcggagaaggcgtgggctgtgttcagtggcatcgaagctgagggcggatacagtgcagcttgtgcatccggcacggtgactgccatgcttgatcagacgtgggagcagactcgcgctgatgtggcgtcgagaaagaagaagctcactggaattaatgagttcccgaacttggcggagtctccgctgccagctgatcgtcgggtagaacctgcaggtgtgcgtcgatgggcagcggattttgaagcgctgcgcaatcgttcggatgctttcttggaaaagaacggcgcgaggccacagatcacgatgattcctctgggaccgttgtccaagcacaatattcgcactggttttacttccaacctgttggcttccggtggcattgaagcaatcaacccgggtcaacttgttcccggcactgacgcttttgcagaagctgcacaggccgcaggcattgtagtggtgtgtggaacggaccaagagtatgccgaaacgggggagggagccgtcgaaaagctccgcgaagcgggcgttgagcgcatcctgcttgctggcgcgccgaagagctttgagggcagcgcgcatgcgcccgatggttatttgaacatgacaattgatgccgcggcgacgctggctgacctgctagatgctttgggagcttaaatcatgacgtcgatccctaatttttca

SEQ ID NO: 2 - protein, 616 aa, Corynebacterium glutamicum
LTDLTKTAVPEELSENLETWYKAVAGVFARTQKKDIGDIAVDVWKKLIVTTPDGVDINPLYTRADESQRKFTEVPGEFPFTRGTTVDGERVGWGVTETFGHDSPKNINAAVLNALNSGTTTLGFEFSEEFTAADLKVALEGVYLNMAPLLIHAGGSTSEVAAALYTLAEEAGTFFAALTLGSRPLTAQVDGSHSDTIEEAVQLAVNASKRANVRAILVDGSSFSNQGASDAQEIGLSIAAGVDYVRRLVDAGLSTEAALKQVAFRFAVTDEQFAQISKLRVARRLWARVCEVLGFPELAVAPQHAVTARAMFSQRDPWVNMLRSTVAAFAAGVGGATDVEVRTFDDAIPDGVPGVSRNFAHRIARNTNLLLLEESHLGHVVDPAGGSYFVESFTDDLAEKAWAVFSGIEAEGGYSAACASGTVTAMLDQTWEQTRADVASRKKKLTGINEFPNLAESPLPADRRVEPAGVRRWAADFEALRNRSDAFLEKNGARPQITMIPLGPLSKHNIRTGFTSNLLASGGIEAINPGQLVPGTDAFAEAAQAAGIVVVCGTDQEYAETGEGAVEKLREAGVERILLAGAPKSFEGSAHAPDGYLNMTIDAAATLADLLDALGA

SEQ ID NO: 3 - DNA, 1306 bp, Corynebacterium glutamicum
  CDS (101)..(1276): RXA00196
actgcgctttcgcagtcatcatgcaggcataacctgaaacccatccgtttggattgccccaaatgggtgtagtgggtgcgtttacccaacaagtgcaagaatgggagtcgtgactaaaaagatccttattttgggaagcactggttcgattggaactcaggcgctggacgttattgctgataattcagacaagtttgaggtggtgggtatcgctgcgggcggttctcagccagacctcgttatttcgcaggcgcagcagttggggctggctgcagacaaggttgcggttgctgatgcacaggctgccgcagtaatttcgaaggctctcggcggcgagatcatctctggaaccgatgctgcgaagattctggtggaaaccacaaaggccgacactgtgcttaatgctctggttggttctttggggcttgcggcaacgctggccactctggaatctggtgcgcatcttgccttggctaacaaagaatcgctggttgccggtggtgagtttgttacctcaaaggcaaagctggggcagatcattccggtcgattcggagcactctgccatggcgcagtgtttgcgttcgggtactcgtgatgaggttgcgcggattgtgctgacagcttcgggcggacctttcaggggctggaccagggagaagatgtgggaggtgactcccgagcaggcagcagcgcacccaacgtgggcgatggggcagatgaacacgttgaactccgccacccttattaataaaggcctcgaactcatcgaggcgaccctgctgtttgaaacggatgcggatctcattgatgtgacggtgcatccgcagtcgatcatccactccatgatcacgtttacggatggtgcgaccatcgcgcaggcgtcgccaccatcgatgaaactgccgatcgcgttggcgcttgattggccacatcgggtgccgaaggctcagccggcgctggatttcaccgctgctcatacctgggcttttgagccggtggatgatgccgcattccctgcggtgcagctggctaggcacgtcgcaaagcaaaaaggcacgtaccccgcggtgtataacgccgccaacgaggaggcggctgaggcgtttttgcgcgggcgaatcaagtttccgcagatcgtggacgtggtggacgaggtcctccaaggagcttctcagtttgctggtgtagcatcacacgtcgatgatattttggcaaccgaatctgaggcacgcgcgcgtgcgaatgctttgatcaaccggttggcaaccaacttgtaagctaaggagcttccgcctcgtggcagc

SEQ ID NO: 4 - protein, 392 aa, Corynebacterium glutamicum
MGVVTKKILILGSTGSIGTQALDVIADNSDKFEVVGIAAGGSQPDLVISQAQQLGLAADKVAVADAQAAAVISKALGGEIISGTDAAKILVETTKADTVLNALVGSLGLAATLATLESGAHLALANKESLVAGGEFVTSKAKLGQIIPVDSEHSAMAQCLRSGTRDEVARIVLTASGGPFRGWTREKMWEVTPEQAAAHPTWAMGQMNTLNSATLINKGLELIEATLLFETDADLIDVTVHPQSIIHSMITFTDGATIAQASPPSMKLPIALALDWPHRVPKAQPALDFTAAHTWAFEPVDDAAFPAVQLARHVAKQKGTYPAVYNAANEEAAEAFLRGRIKFPQIVDVVDEVLQGASQFAGVASHVDDILATESEARARANALINRLATNL

SEQ ID NO: 5 - DNA, 1081 bp, Corynebacterium glutamicum
  CDS (101)..(1051): RXA00224
gtgatgtcattggtgcatcgggtgctgctgaaaagattgctgagtacctcgcttcagagaacctcatctagccactatcttcacaaaggagaacatttaaatgtctatttcttatgtgctggttgagcagctagatggccgcccagaaccagttacccttgaattgatcactgctgctcgcgcactcggtgacgtcgttgccgttgtcgttggcgagccaggtgccggcgtaaaccttgctgctgagctcggcaattggggtgcagcacaggttgtttccgctgaaatctctggcgcttccaaccgtttgatcttgcctgctgttgatgcgctgcacattttggctgcgaacaacccaggtccaattgttatcgctgcaactgcaagcggtaatgagatcgctggtcgtttggctgcccgtttggcttctggtgtgctcaccgatgtcgtcggaatcaatgccgaccgcaccgcacagcagtccattttcggcgacaccattcaggtgtccgctgcagttggtggcgcttcaccgctgtacaccctgcgtccaggtgcccttgatggcgtggccgttcctgcaaccggtgaattggcaaccattgagatcccaggcgcaaccgccaaggatgtcaccatcacctccttcacgccaagcacccagagcgatcgccctgagctgccacaggcaaaggtcgttatcgcaggtggacgtggtgtcggaagcgaagaaaacttccgcagcatcgttgaaccactggcagatgcattgggcggtgccgttggcgcaacccgcgacgccgttgatctgggctactacccaggcgagtaccaggttggtcagaccggtgtcaccgtgtccccagacctctacatcggcctcggcatttccggtgcaattcagcacacttctggtatgcagaccgcaaagaaggttattgtgatcaacaacgatgaggacgcgccgatcttccagattgcggacctcggtgtcgttggcgacctctttgacatcgcccctgcgctcatcgaagagatcaacaagcgcaagtaggagttttgaacactttttatctggacc

SEQ ID NO: 6 - protein, 317 aa, Corynebacterium glutamicum
MSISYVLVEQLDGRPEPVTLELITAARALGDVVAVVVGEPGAGVNLAAELGNWGAAQVVSAEISGASNRLILPAVDALHILAANNPGPIVIAATASGNEIAGRLAARLASGVLTDVVGINADRTAQQSIFGDTIQVSAAVGGASPLYTLRPGALDGVAVPATGELATIEIPGATAKDVTITSFTPSTQSDRPELPQAKVVIAGGRGVGSEENFRSIVEPLADALGGAVGATRDAVDLGYYPGEYQVGQTGVTVSPDLYIGLGISGAIQHTSGMQTAKKVIVINNDEDAPIFQIADLGVVGDLFDIAPALIEEINKRK

SEQ ID NO: 7 - DNA, 1405 bp, Corynebacterium glutamicum
  CDS (101)..(1375): RXA00235
cgaaacaagattcgtgcaacaattgggtgtagacgtgattgaagacatttgatcacgtgaataattctagttagctcccaagttggcataggaggccacagtggctgaaatcatgcacgtattcgctcgcgaaattctcgactcccgcggtaacccaaccgtcgaggcagaggttttcctggatgacggttcccacggtgtcgcaggtgttccatccggcgcatccaccggcgtccacgaggctcatgagctgcgtgacggtggcgatcgctacctgggcaagggcgttttgaaggcagttgaaaacgtcaacgaagaaatcggcgacgagctcgctggcctagaggctgacgatcagcgcctcatcgacgaagcaatgatcaagcttgatggcaccgccaacaagtcccgcctgggtgcaaacgcaatccttggtgtttccatggctgttgcaaaggctgctgctgattccgcaggcctcccactgttccgctacatcggtggaccaaacgcacacgttcttccagttccaatgatgaacatcatcaccggtggcgctcacgctgactccggtgttgacgttcaggaattcatgatcgctccaatcggtgcagagaccttctctgaggctctccgcaacggcgcggaggtctaccacgcactgaagtccgtcatcaaggaaaagggcctgtccaccggacttggcgatgagggcggcttcgctccttccgtcggctccacccgtgaggctcttgaccttatcgttgaggcaatcgagaaggctggcttcaccccaggcaaggacatcgctcttgctctggacgttgcttcctctgagttcttcaaggacggcacctaccacttcgaaggtggccagcactccgcagctgagatggcaaacgtttacgctgagctcgttgacgcgtacccaatcgtctccatcgaggacccactgcaggaagatgactgggagggttacaccaacctcaccgcaaccatcggcgacaaggttcagatcgttggcgacgacttcttcgtcaccaaccctgagcgcctgaaggagggcatcgctaagaaggctgccaactccatcctggttaaggtgaaccagatcggtaccctcaccgagaccttcgacgctgtcgacatggctcaccgcgcaggctacacctccatgatgtcccaccgttccggtgagaccgaggacaccaccattgctgacctcgcagttgcactcaactgtggccagatcaagactggtgctccagcacgttccgaccgtgtcgcaaagtacaaccagcttctccgcatcgagcagctgcttggcgacgccggcgtctacgcaggtcgcagcgcattcccacgctttcagggctaaataaaagcgcttttcgacgcccggtaa

SEQ ID NO: 8 - protein, 425 aa, Corynebacterium glutamicum
VAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIITGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 9 - DNA, 2974 bp, Corynebacterium glutamicum
  CDS (101)..(2944): RXA00296
tttttgttggcatgtctgacattatcgcacaattcaccacagtaaccggtaacatgttactcaaagcccgcttggatcgaatttcacaaaaggacccaccatgactcacaccatcaaattcaacagactcgacccagaagtatttagccagcattctcgcgcgaagctgcgcacggatatgacaacccgtgcagcatattcttctgatgcaggaatttttagacgcgtccctgcagctgtagctgaaccagaaaatgtggaacaaattcgtgatgccattgctgttgcggtggcacgagggtggtctgttgttgggcgcggtggaggaagctcggttgctggaaatgcgatcggtgaaggtttgatcatcgatacgtcacgctatttcaaccgcattttagatattgatccagttgcacaaactgcagttgtggaacccggtgtggtgtgtgatgccttgcgcgatgcagccgcagaattcggattaacttacggcccggatccttccacgcattcccggtgcacgatcggtggcatggttgccaacaatgcgtgtggttcacactcggttgcattcggtacagctgcggaaaatctcgtggatgtcacgctcatgctcagcgatggccgagaagtcactgtgacaaaagatggctgcgatgatgctgagatcaatcagaagctcaccgacttagcgtccaagaatcaggaccttattagtaaagaactgggtcgtttccctcgccaagtgtcgggctacggtttgcattatcttgcccacgacatggccaaagcaatggcgggcaccgagggaaccattggaatcattactcggttgacggtgaagttggttccaacacccaaagtgaaagcgcttgctgtcctggctttcgacacggtttttgacgccgcccgagcagccgccaaattgcgactgcctggggtagcaaccattgaaggcatgggcggagatctcctcgctgcgctgcgcagtaaacagggacaatcagaagctgggcagaatcttccaggaaaccgcatcggcattgaagccggcggatggttgtactgcgagacaggaagtgacaccctgcaggccgcggtacaagccgccgaggaagtcgcaaccgccgttgacaccattgattacgtggtcgtgtctgagccttctgaaatgcgggaattgtggcgcatccgtgaatcctcggcgggcattgtcacgcgcttagctgatggtggggaagcgtggccgaattgggaagactcggcggtgcctccagagaatttagctgattatctccgcgatctttatgcgctgatggataagttcgattaccagggtattccatttggacactttggagaaggctgcgtccacgttcgcatcagttttgatttctctaccaaggaaggcctgaagaaattcgaggcgttcatgaatgaagcctccaccttggtggcgtcttatggtggcagcctctcgggcgagcatggagacggtcgcgcccgctcatccttccttgaccgcatgtattcagcagaaatgcgtgcactcttcgaagaattcaagctgattttcgatccccagcgcatcttcaatccgggagtgttggtctgggcagatcctgtcatgcaaggacttcgcatggacccgggccagcgcgccctcgacatcacgcccgtacacaaattctctaaagacaaaggttccatgatcaacgcggtgaatcgctgcgtgggtgtatccgcatgccgctcagaatccgacgcgatgtgcccgtccttccaaatcaccggcgacgaagtacattccaccagaggccgcgcccgcttgctctctgagatgttccgcggtgaatccatcgccgacggctaccgcagcgaagaagtcaatgaagcccttgacctgtgcctttcctgcaaagcatgcgcatcggaatgtccagtcaacgtcgacatgtccacctacaaagccgaattcctggacaaacactacgccggccgacttcgccccatggcccattacgtcatgggctggctgccgcttctgggacacgttgcccataaaataccgcttcttcctacgcttatcgacgccaccatgcagtcagcactcaccgccccagtggtgcgcaaggtcggcgggctcgctgatcgcccgttgatttccttcgcccaccgctcgctgcgcaagtacaagccgaagaaaaactcaggtgaaacggtggtgctgtggcccgattccttcaacaccaacctcgacaccggaccagctcacgcagcgatcaaaactcttgaagccctcggttacaacgtggtcatcccagatggcttcgtctgctgtggactcacctggcattccaccggccaattgagcatgacaaagaaagtcctagaacaaacggcgaaagtgatgaaaccctacctggaccaaggtctaacagtcgttggtttggaaccttcgtgcaccgtcatgcttcaagatgaggcaacagaactctccgataaccctgatctggcacgccttgcagcactgaccaaaccattcgctgaggtcatcgcaccaaagatcaccgagctagtcgagtctggaagcctccagctaacagaatcaactgcgcttacccaggtgcactgccacgagcgttcgctaggcgacccacaacaatcggcactcgttcttgaagctttgggtgtaaaagatgaacaaattgccactggttgttgcgggcttgccggaaactggggctttgaaaaagaccacgctgaaatgtccttcgcacttggtgaacgagagctgttccccaaggtcagaaaagcagaaggacatgtgattgctgacggtttctcctgccgcacccagatcgaacaaggcaccggaaaacaagcaacgcaccttgcagaggtggtcttaagcatcttggagcaaaacaacatggcacaataacgatcatgcaacaggtgctcatgggtt

SEQ ID NO: 10 - protein, 948 aa, Corynebacterium glutamicum
MTHTIKFNRLDPEVFSQHSRAKLRTDMTTRAAYSSDAGIFRRVPAAVAEPENVEQIRDAIAVAVARGWSVVGRGGGSSVAGNAIGEGLIIDTSRYFNRILDIDPVAQTAVVEPGVVCDALRDAAAEFGLTYGPDPSTHSRCTIGGMVANNACGSHSVAFGTAAENLVDVTLMLSDGREVTVTKDGCDDAEINQKLTDLASKNQDLISKELGRFPRQVSGYGLHYLAHDMAKAMAGTEGTIGIITRLTVKLVPTPKVKALAVLAFDTVFDAARAAAKLRLPGVATIEGMGGDLLAALRSKQGQSEAGQNLPGNRIGIEAGGWLYCETGSDTLQAAVQAAEEVATAVDTIDYVVVSEPSEMRELWRIRESSAGIVTRLADGGEAWPNWEDSAVPPENLADYLRDLYALMDKFDYQGIPFGHFGEGCVHVRISFDFSTKEGLKKFEAFMNEASTLVASYGGSLSGEHGDGRARSSFLDRMYSAEMRALFEEFKLIFDPQRIFNPGVLVWADPVMQGLRMDPGQRALDITPVHKFSKDKGSMINAVNRCVGVSACRSESDAMCPSFQITGDEVHSTRGRARLLSEMFRGESIADGYRSEEVNEALDLCLSCKACASECPVNVDMSTYKAEFLDKHYAGRLRPMAHYVMGWLPLLGHVAHKIPLLPTLIDATMQSALTAPVVRKVGGLADRPLISFAHRSLRKYKPKKNSGETVVLWPDSFNTNLDTGPAHAAIKTLEALGYNVVIPDGFVCCGLTWHSTGQLSMTKKVLEQTAKVMKPYLDQGLTVVGLEPSCTVMLQDEATELSDNPDLARLAALTKPFAEVIAPKITELVESGSLQLTESTALTQVHCHERSLGDPQQSALVLEALGVKDEQIATGCCGLAGNWGFEKDHAEMSFALGERELFPKVRKAEGHVIADGFSCRTQIEQGTGKQATHLAEVVLSILEQNNMAQ

SEQ ID NO: 11 - DNA, 1690 bp, Corynebacterium glutamicum
  CDS (101)..(1660): RXA00389
ccaccactgcgtaacctttccgagcaagatatcgcggacctgtcggatttgcttgccacctctggcgcaggttcctaccgccttcagttgaggtgaaagcatgatcaccgcaaccgcactgcatgggtgttcactgattgatggcgagtgggtcgctggaaaaaatggtgagattacaggattcgatccgcgcaccaatgcgagtctgaacccttcctactctttagcaaacagcgcacagctgcgcgccgccacaacatcggcgaagcgagcttttgaaagctaccgactcactactccagaggttagagcagatttcctggattccatcgctgacaacatcgatgcgctatccggcgagatcgtgcaacgggcgagcctggagacaggtttgggaactacccgactcacaggcgaagtagcccgcaccagcaaccagctccgcctgtttgcagaaaccgtgagaagcggacagttccaccgagtacgcattgaacgaggaccgcggattgatcttcgccagcgtcaggttccgttgggaccagtcgcggtattcggggcaagcaacttccccgtcgctttctctactgctggtggcgatacagcatcagcgttggctgcaggctgccctgtggtttttaaggcgcataatgcgcaccctggaacagctgagctcgtcgggcaagcggtgcggggagccgtcgaaaagcatgagtttgatgctggtgtgtttaaccttgtctacggccgtggcgtggaaattggccaggagctggctgcggatccgaatatcacggcaatcggttttaccggttcacgccagggtggtttggcactgtcacagactgcgtttagccgcccagttcccgttccagtctttgcagaaatgagtgccaccaaccctgtgttcgtcttccccggcgcgctggcggatttggatgcatcgagttccttggctgaggcgtttaccgcttccgtcaccggcagttccgggcaattgtgcaccaagcctggcctcgttttcatcccgcgcggtgttgttggtgatgcttttgtggcgctcgtagcagccaaatttaaagaaaccacgggtcaaacgatgctcacgcaaggcatcgctcaggcatggcagcgcggagtcgacaaccttgcagcacagccaagtgtaaaaatcctcgcccaaggcacccccggagatggagagaacgcgccgggcccggtggtgtttgaaagtgatgtgcaggcgttgctaaataatgtggtgttgcaggaagaaatcttcggtgcggcatcgctggtggtgcgttatgattccccggatcaactccaccaagtagccaattcactcgagggacaattaacagccacgatccacgcatcccaggatgatttccaggaagtctcgaaacttatccccctcttggaggatctcgcgggccgtgttctttacggcggctggccaacgggtgtggaagttgggcacacggttatccatggaggcccttatccggcgacctcaaatgcgcagtcgacaagtgttggaaccctggcaatcgagagatttatgcgcccggtttcttatcaaactttcccggctgagctgcttccagatccagtttctgaggcgaataaatgggctgtacctcgggaaatagaccgttaatagctggtctttacatttgccagaaag

SEQ ID NO: 12 - protein, 520 aa, Corynebacterium glutamicum
MITATALHGCSLIDGEWVAGKNGEITGFDPRTNASLNPSYSLANSAQLRAATTSAKRAFESYRLTTPEVRADFLDSIADNIDALSGEIVQRASLETGLGTTRLTGEVARTSNQLRLFAETVRSGQFHRVRIERGPRIDLRQRQVPLGPVAVFGASNFPVAFSTAGGDTASALAAGCPVVFKAHNAHPGTAELVGQAVRGAVEKHEFDAGVFNLVYGRGVEIGQELAADPNITAIGFTGSRQGGLALSQTAFSRPVPVPVFAEMSATNPVFVFPGALADLDASSSLAEAFTASVTGSSGQLCTKPGLVFIPRGVVGDAFVALVAAKFKETTGQTMLTQGIAQAWQRGVDNLAAQPSVKILAQGTPGDGENAPGPVVFESDVQALLNNVVLQEEIFGAASLVVRYDSPDQLHQVANSLEGQLTATIHASQDDFQEVSKLIPLLEDLAGRVLYGGWPTGVEVGHTVIHGGPYPATSNAQSTSVGTLAIERFMRPVSYQTFPAELLPDPVSEANKWAVPREIDR

SEQ ID NO: 13 - DNA, 1261 bp, Corynebacterium glutamicum
  CDS (101)..(1231): RXA00412
caatcacagcctgaaaatcagactgtgaacttcaaacgccccgcttggaatcttttgacgaacaccacgtcgcgtacgcttcctcggggcgttaaactatttgtcttccagcttttgtcccccgacttttgtacgaatcgaggacaccgtcgtgtcacacaccgcgtccacaccgacgccagaggaatactccgcgcagcaacccagcacccagggcactcgcgttgagttccgcggcataaccaaagtctttagcaacaataaatctgctaaaaccaccgcgcttgataatgtcactctcaccgtagaacccggtgaggtaatcggcatcatcggttactctggcgccggcaagtccactcttgtccgcctcatcaatggccttgactcccccacgagcggttcgttgctgctcaacggcaccgacatcgtcggaatgcccgagtctaagctgcgtaaactgcgcagtaatatcggcatgattttccagcagttcaacctgttccagtcgcgtactgcggctggaaatgtggagtacccgctggaagttgccaagatggacaaggcagctcgtaaagctcgcgtgcaagaaatgctcgagttcgtcggcctgggcgacaaaggcaaaaactaccccgagcagctgtcgggcggccagaagcagcgcgtcggcattgcccgtgcactggccaccaatccaacgcttttgcttgccgacgaagccacctccgctttggacccagaaaccacccatgaagttctggagctgctgcgcaaggtaaaccgcgaactgggcatcaccatcgttgtgatcacccacgaaatggaagttgtgcgttccatcgcagacaaggttgctgtgatggaatccggcaaagttgtggaatacggcagcgtctacgaggtgttctccaatccacaaacacaggttgctcaaaagttcgtggccaccgcgctgcgtaacaccccagaccaagtggaatcggaagatctgcttagccatgagggacgtctgttcaccattgatctgactgaaacgtccggcttctttgcagcaaccgctcgtgctgccgaacaaggtgcttttgtcaacatcgttcacggtggcgtgaccaccttgcaacgccaatcatttggcaaaatgactgttcgactcaccggcaacaccgctgcgattgaagagttctatcaaaccttgaccaagaccacgaccatcaaggagatcacccgatgaacgagatgatcctcgcagctgactgga

SEQ ID NO: 14 - protein, 377 aa, Corynebacterium glutamicum
LSSSFCPPTFVRIEDTVVSHTASTPTPEEYSAQQPSTQGTRVEFRGITKVFSNNKSAKTTALDNVTLTVEPGEVIGIIGYSGAGKSTLVRLINGLDSPTSGSLLLNGTDIVGMPESKLRKLRSNIGMIFQQFNLFQSRTAAGNVEYPLEVAKMDKAARKARVQEMLEFVGLGDKGKNYPEQLSGGQKQRVGIARALATNPTLLLADEATSALDPETTHEVLELLRKVNRELGITIVVITHEMEVVRSIADKVAVMESGKVVEYGSVYEVFSNPQTQVAQKFVATALRNTPDQVESEDLLSHEGRLFTIDLTETSGFFAATARAAEQGAFVNIVHGGVTTLQRQSFGKMTVRLTGNTAAIEEFYQTLTKTTTIKEITR

SEQ ID NO: 15 - DNA, 1669 bp, Corynebacterium glutamicum
  CDS (101)..(1639): RXA00483
ttattacttctaaaagtatagtagatagttgtggatgggtgaagaatttcatagaaatcgcactcgattcactaaagacccaagagtaaaatcccaggatttgcttatacttgcgctcatggataatcaacttcgtcccactttgcattatcaagctcaaaacccgcaccggcgagtgctggtcaccggtgcgacaggctacattggcggcaggttgattactgagttacttgctgccggtttccaagttcgggccacctcgaggaaaaaaacaagtcttcagcgctttgactggtacgaggacgtcgaggcagtggaagcggatctgactgacgcgactgagttagatacgttatttaaggatgtagacgttgtttactatctagtgcattccatgggaggtaagaatgttgattttgaagagcaagagcaacgcactgctgaaaatgtaattcaagctgctgatcaagccgggataaaacagattgtctacctttccggcttacacccgcgtaatcgaaaaatagaagaactatctaagcacatgcgctcacgggaaaaggtcgcccagattttgctggcaggccagacaccagctttaattttaagggctgccacaattattggttccggctctgcatcatttgaaataatccgtcatctcacggagcgtttgcctagaatgatagcgcctcagtggattactaatcagattgagcctttagcaatacgggatgttttgcattacctaatctcggcggctgatttaaaggatccagtcaaccgctcctgcgatattgggtgtggaaagtcgtatgaatttgcggatctattgcgtatctatgccgatgttcggggactgaaacgtcatgtaaattccgtacctctcaatttgcccatggacaagctatccggtctttggattagtctagtgacacctgttccatttcaattgtctttccctttagctcaatcaatggctgaggatgccgtcactgaagagcacagcattaaagatattatttcagatccacccgatggttttattgagtatcgggaagcagtggagctggcattagctgcagaatttgatcgtggagttccaacgtcatgggatcgaagctggactgtacaacaaccgtgggctggccagcctaccgatccagagtgggcgggcaaagctgtatatgaagacgtccgcacagaagatactgatctccgagcagcgcaggtctggccgatcattgaaggtttgggtggcgtgaacggctggtattctgcaccactgctatggcgattgcggggtatcgctgacagactcatcggcggtccaggtttgggcggacggcgggatccccgtcatttgaaacttggggatcgcattgattggtggcgggttactgagatcgatccaccacatagattagtgctcaccgcagagatgaaagtagatggtggcgcttggctgatcctggaagttgcggacaaggaaaatggcggatgtacttatacccagcgcgcaatatttgagccgaagggtttgcccggttatctctattggtgggttgtttcaccgttccatgcgattatttttccttatatgcgttcgaatattttaaaagctgcgcgtaaactcacttaatcgcagagtaggcgtctaaagcaattt

SEQ ID NO: 16 - protein, 513 aa, Corynebacterium glutamicum
LLILALMDNQLRPTLHYQAQNPHRRVLVTGATGYIGGRLITELLAAGFQVRATSRKKTSLQRFDWYEDVEAVEADLTDATELDTLFKDVDVVYYLVHSMGGKNVDFEEQEQRTAENVIQAADQAGIKQIVYLSGLHPRNRKIEELSKHMRSREKVAQILLAGQTPALILRAATIIGSGSASFEIIRHLTERLPRMIAPQWITNQIEPLAIRDVLHYLISAADLKDPVNRSCDIGCGKSYEFADLLRIYADVRGLKRHVNSVPLNLPMDKLSGLWISLVTPVPFQLSFPLAQSMAEDAVTEEHSIKDIISDPPDGFIEYREAVELALAAEFDRGVPTSWDRSWTVQQPWAGQPTDPEWAGKAVYEDVRTEDTDLRAAQVWPIIEGLGGVNGWYSAPLLWRLRGIADRLIGGPGLGGRRDPRHLKLGDRIDWWRVTEIDPPHRLVLTAEMKVDGGAWLILEVADKENGGCTYTQRAIFEPKGLPGYLYWWVVSPFHAIIFPYMRSNILKAARKLT

SEQ ID NO: 17 - DNA, 1498 bp, Corynebacterium glutamicum
  CDS (101)..(1468): RXA00511
gggttttccgcattcttggggtttcttgtgacttagggacttgggtttacacagctcaaccgaagaaaaattgttcaatagagttttgaacaatgcgatcttggccaggccgtgcataattaatcgcatgactcgactatttggaactgatggcgtccgcggactagccaatgaagtactcaccgcacctttggccttgaagctgggggccgctgcagctcacgtacttaccgcagagaaacgggtagatggacgtcgcccggttgcgatcgttggtagggatcctcgagtctctggagagatgctcgcggcagcactttcagcaggcatggccagccagggtgttgatgtcattcgtgttggtgtcatcccaacccctgctgttgcattcctcaccgatgattatggcgctgacatgggcgtgatgatttctgcatcccacaacccaatgccggacaacggaatcaagttcttctctgcaggtggacacaagcttccagaccatgtggaagacgagattgagcgtgttatggacagcttgccagcagaaggcccaacagggcatggagttggccgtgtcatcgaagaagcaaccgatgcacaggaccgttacctagagcacctgaaggaagctgttcctacgtcacttgaaggcatcaagattgttgtggatgcagccaatggtgcggcaagtgttgtagctccaacggcttatgaggctgcgggtgcaactgtaattgctattcataacaagccagactcatacaacatcaacatggactgcggttccacccacattgatcaggtgcaggcggcagtcctgaagcacggtgctgaccttggactcgcgcatgacggtgatgctgaccgttgtttggctgtggacaaggatggcaaccttgttgatggtgaccaaatcatggcgctgttagccattgcgatgaaagaaaacggcgagctgcgcaagaacaccctcgtgggcactgtcatgagcaacctgggattgaagattgctatggatgaagccggaattacactgcgtaccaccaaggtaggagaccgctacgtgctggaagacctcaatgcaggtggattcagcctgggcggcgagcaatctggccacattgttcttccagatcatggcaccactggcgatggaactttgactggtctttccatcatggcgcgcatggctgaaaccggaaagtccttgggcgagttggcacaagctatgacggtgctgccacaggttctgatcaatgtgccagtttcggataagtccaccatcgtgagccacccaagcgttgtggctgcgatcgcggaagcagaagctgagttgggcgccaccggtcgcgttcttcttcgtgcttctggcaccgaagagcttttccgcgtgatggttgaggctggagacaaggaacaagctcgtcgtatcgcgggacgtcttgctgcagtggttgcagaagtctaattcacttcagtcacagcgcaacgcgat

SEQ ID NO: 18 - protein, 456 aa, Corynebacterium glutamicum
LARPCIINRMTRLFGTDGVRGLANEVLTAPLALKLGAAAAHVLTAEKRVDGRRPVAIVGRDPRVSGEMLAAALSAGMASQGVDVIRVGVIPTPAVAFLTDDYGADMGVMISASHNPMPDNGIKFFSAGGHKLPDHVEDEIERVMDSLPAEGPTGHGVGRVIEEATDAQDRYLEHLKEAVPTSLEGIKIVVDAANGAASVVAPTAYEAAGATVIAIHNKPDSYNINMDCGSTHIDQVQAAVLKHGADLGLAHDGDADRCLAVDKDGNLVDGDQIMALLAIAMKENGELRKNTLVGTVMSNLGLKIAMDEAGITLRTTKVGDRYVLEDLNAGGFSLGGEQSGHIVLPDHGTTGDGTLTGLSIMARMAETGKSLGELAQAMTVLPQVLINVPVSDKSTIVSHPSVVAAIAEAEAELGATGRVLLRASGTEELFRVMVEAGDKEQARRIAGRLAAVVAEV

SEQ ID NO: 19 - DNA, 820 bp, Corynebacterium glutamicum
  CDS (101)..(790): RXA00526
ggtggagcaggcggcggctccttttagtcctgcggccccttttgaccctgcagcccctgccgtttctgccaagcaaaccgtgggccaggtgatttagcctatgagcctcatcgaaatgcgaaatattgtcaagacctacaacattggatctgaaggtgaactcaccgtgttgcacggtgtggatttccatgtggaccgtggcgaattcgtgtcggttgtgggtacgtccggctcaggtaaatcaacgatgatgaacatcattgggttgttggataagccaactgatggcacgtacaccttggatggcgtggatgtgttggatatcagcgatgatgctttggcgagccaccgcgctaaatcgattggttttgtgtttcagaacttcaatctgattggccggatcgatgcgttgaagaatgtggaaatgcccatgatgtatgcgggcattccggctaagcagcggagaagtcgtgcggttgaattattggaaatggtcgggatgggtgagcgtctcaaccatgagcccaatgagctttcgggtggtcagaagcagcgcgtggccattgctcgcgcgttggcgaacgatcctgagatcattcttgctgatgaaccaactggtgcgttggattctgcaacgggccggatggtgatggatattttccaccagctcaacaaggagcagggcaaaaccatcgtgtttattactcacaaccctgagcttgctgatgaatctgatcgggtggtcaccatggttgacgggcgcatcattgggtctgaggtgaaacactcatgagccttgcagaatcaattcttttggcgc

SEQ ID NO: 20 - protein, 230 aa, Corynebacterium glutamicum
MSLIEMRNIVKTYNIGSEGELTVLHGVDFHVDRGEFVSVVGTSGSGKSTMMNIIGLLDKPTDGTYTLDGVDVLDISDDALASHRAKSIGFVFQNFNLIGRIDALKNVEMPMMYAGIPAKQRRSRAVELLEMVGMGERLNHEPNELSGGQKQRVAIARALANDPEIILADEPTGALDSATGRMVMDIFHQLNKEQGKTIVFITHNPELADESDRVVTMVDGRIIGSEVKHS

SEQ ID NO: 21 - DNA, 1222 bp, Corynebacterium glutamicum
  CDS (101)..(1192): RXA00683
ggacaaagctatcgggttccgggagaacctctccttccgcgtccccacttctgttcccgtgacttggaacgcttaacgctttattaaataaggagacaccatgaccaacagtttgaacatcccgtttgtccagcgcttcgatgaaggcctggatcctgttctagaagtactcggtggcaagggcgcttcactagtcaccatgacagatgctggaatgcccgttccacctggatttgtggtcactactgccagctttgatgaattcatccgtgaagcaggggttgctgaacacatcgataaattcctaaacgatctcgatgcagaagatgttaaggaagtggatcgagtttctgcgatcatccgcgatgagctgtgcagtcttgacgttccagagaatgctcgtttcgcagtgcaccaggcttatcgcgatctcatggaacgatgcggtggcgacgtcccggttgctgtccggtcatcggccactgccgaagatctgcccgatgcttccttcgcagggcaacaggacacctatctgtggcaagtcggtttgagcgctgtcactgaacacatccgtaaatgctgggcttcgctgttcacttcccgtgccattatctaccgtctgaaaaacaacatccccaatgagggcctctccatggcggtagttgttcaaaaaatggtcaactctcgtgtcgcaggcgtggcaatcactatgaatccttccaacggcgaccgctcgaagatcaccatcgattcctcatggggtgttggtgaaatggtggtctcaggtgaagtgacaccagacaatatcttgctggacaagatcacgctgcaggttgtctccgaacacattggaagcaaacacgctgaactcatccccgatgccaccagtggaagcctcgtggaaaagcccgttgatgaagaacgcgcaaaccgccgcagtctgactgatgaggaaatgctcgctgtggcacaaatggctaagcgtgcagaaaaacactacaagtgcccacaagatatcgaatgggcgctggacgctgatctgccagatggagaaaaccttctgttattgcaatcccgcccggaaactatccactccaacggtgtgaagaaggaaaccccaactccgcaggctgccaaaaccataggcaccttcgatttcagctcaatcaccgtcgcaatgaccggcacgaagtaaaaccaccgcatcttttcgtcgaaaagc

SEQ ID NO: 22 - protein, 364 aa, Corynebacterium glutamicum
MTNSLNIPFVQRFDEGLDPVLEVLGGKGASLVTMTDAGMPVPPGFVVTTASFDEFIREAGVAEHIDKFLNDLDAEDVKEVDRVSAIIRDELCSLDVPENARFAVHQAYRDLMERCGGDVPVAVRSSATAEDLPDASFAGQQDTYLWQVGLSAVTEHIRKCWASLFTSRAIIYRLKNNIPNEGLSMAVVVQKMVNSRVAGVAITMNPSNGDRSKITIDSSWGVGEMVVSGEVTPDNILLDKITLQVVSEHIGSKHAELIPDATSGSLVEKPVDEERANRRSLTDEEMLAVAQMAKRAEKHYKCPQDIEWALDADLPDGENLLLLQSRPETIHSNGVKKETPTPQAAKTIGTFDFSSITVAMTGTK

SEQ ID NO: 23 - DNA, 1414 bp, Corynebacterium glutamicum
  CDS (101)..(1384): RXA00684
agtcacacctaaaagtgatagccatcacgaatctttaggaaaagtgattcaaacttcactgtgatcggcttcggccacacacaagtgtcaggagatgacaatgacttcccagacttcccaacaatccacctcaaccggtggatgcccattcgggcacacatcagagtccaccagccatcacggctaccagcctttcgatatgcacaacccgtttcctgcatataaagaactccgtcaggaagagccagtgatgttcgatgagcgcatcggctactgggtggtaaccaaatatgacgacatcaaaaccacctttgatgactgggaaacattctcctctgaaaatgcacaagccccagtccgcaagcgtggacctcaggcaacccaaatcatgaccgatggcggcttcactgcatactccggattatcagctcgtattccaccagagcacacccgcatccgcgcaatcgcacaaaaggccttcacgccacgccgctataaagcactcgaaccagatatccgagcaatggtgattgatcgtgtggagaaaatgttggcgaatgatcaacacgtcggcgatatggtgtcagatcttgcctacgacattccaaccatcacgatcctgacgctgatcggtgcagatatttccatggtggacacctacaagcggtggtcagattcccgtgcggccatgacctggggcgatcttagtgatgaagagcagatcccacacgcacacaatttggttgagtactggcaggaatgccaacgcatggtagctgatgcacatgcacacggtggcgacaacctcaccgctgatctagtgcgagcacagcaagagggtcaagaaatcaccgatcatgagattgcttctttgctgtactccctgctttttgcggggcacgaaacaaccaccacgttgatctccaattgtttccgagttctcctcgatcatccagagcagtggcaagccattctagagaatccaaaactgattcctgcggcagtggatgaggtcttgcggtactccggctcgatcgtggggtggcgtcgaaaagcattaaaagacaccgagatcggcggcgttgccattaaggaaggcgatggtgttctgctgctcatgggttccgcgaaccgcgatgaagctcgctttgaaaatggcgaggaattcgatatcagccgcgctaatgcgcgcgagcacctgtcttttggtttcggcatccactattgcctaggaaacatgctggccaaacttcaagccaagatctgtctcgaggaagtcaccaggcttgttccttccctgcacttggttgcggacaaagctatcgggttccgggagaacctctccttccgcgtccccacttctgttcccgtgacttggaacgcttaacgctttattaaataaggagacaccatg

SEQ ID NO: 24 - protein, 428 aa, Corynebacterium glutamicum
MTSQTSQQSTSTGGCPFGHTSESTSHHGYQPFDMHNPFPAYKELRQEEPVMFDERIGYWVVTKYDDIKTTFDDWETFSSENAQAPVRKRGPQATQIMTDGGFTAYSGLSARIPPEHTRIRAIAQKAFTPRRYKALEPDIRAMVIDRVEKMLANDQHVGDMVSDLAYDIPTITILTLIGADISMVDTYKRWSDSRAAMTWGDLSDEEQIPHAHNLVEYWQECQRMVADAHAHGGDNLTADLVRAQQEGQEITDHEIASLLYSLLFAGHETTTTLISNCFRVLLDHPEQWQAILENPKLIPAAVDEVLRYSGSIVGWRRKALKDTEIGGVAIKEGDGVLLLMGSANRDEARFENGEEFDISRANAREHLSFGFGIHYCLGNMLAKLQAKICLEEVTRLVPSLHLVADKAIGFRENLSFRVPTSVPVTWNA

SEQ ID NO: 25 - DNA, 1402 bp, Corynebacterium glutamicum
  CDS (101)..(1372): RXA00783
aaagttcccaaggggtgggggctgagcaccacggatccaattttgttgcaatttgcaaagtttacagtgttagacttcacaatacgatcatattggtgagttgaaacacttacttttacgggaagactttgttaaagacgcagaaggctctaagcatgggccggaaatggaattggcagtggatctttttgaataccaagcacgggacctctttgaaacccatggtgtgccagtgttgaagggaattgtggcatcaacaccagaggcggcgaggaaagcggctgaggaaatcggcggactgaccgtcgtcaaggctcaggtcaaggtgggcggacgtggcaaggcgggtggcgtccgtgtggcaccgacgtcggctcaggcttttgatgctgcggatgcgattctcggcatggatatcaaaggacacactgttaatcaggtgatggtggcgcagggcgctgacattgctgaggaatactatttctccattttgttggatcgcgcgaatcgttcgtatctggctatgtgctctgttgaaggtggcatggagatcgagatcctggcgaaggaaaagcctgaagctttggcaaaggtggaagtggatcccctcactggtattgatgaggacaaagcgcgggagattgtcactgctgctggctttgaaactgaggtggcagagaaagtcattccggtgctgatcaagatctggcaggtgtattacgaagaggaagcaacactcgttgaggtgaacccgttggtgctcacggatgacggcgatgtgattgcgcttgatggcaagatcacgctggatgataacgctgatttccgccatgataaccgtggtgcgttggctgaatctgccggtggcttggacattttggaactgaaggccaagaagaatgatctgaactacgtgaaacttgatggctctgtgggcatcattggcaatggtgcaggtttggtgatgtccacgttggatatcgtggctgcagctggtgaacgccatggtgggcagcgccccgcgaacttcctagacattggtggcggagcatcagctgaatcgatggctgctggtctcgatgtgatccttggggatagccaggtacgcagtgtgtttgtgaatgtgtttggtggcatcaccgcgtgtgatgtggtggcaaagggaatcgttggagctttggatgtgctcggcgatcaagcaacgaagcctcttgtggtgcgccttgatggcaacaacgtggtggaaggcagacgaatcctcgcggaatataaccaccctttggtcaccgttgtggagggtatggatgcagcggctgatcacgctgcccatttggccaatcttgcccagcacggccagttcgcaaccgctaattagttaaggagcacctgtttaatcatgtct

SEQ ID NO: 26 - protein, 424 aa, Corynebacterium glutamicum
LKHLLLREDFVKDAEGSKHGPEMELAVDLFEYQARDLFETHGVPVLKGIVASTPEAARKAAEEIGGLTVVKAQVKVGGRGKAGGVRVAPTSAQAFDAADAILGMDIKGHTVNQVMVAQGADIAEEYYFSILLDRANRSYLAMCSVEGGMEIEILAKEKPEALAKVEVDPLTGIDEDKAREIVTAAGFETEVAEKVIPVLIKIWQVYYEEEATLVEVNPLVLTDDGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSQVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 27 - DNA, 1072 bp, Corynebacterium glutamicum
  CDS (101)..(1042): RXA00825
gctcagttacccgttcatgctgggctttggtgcggtgatggcaactatttgtctgatcattgtgagttttagtgcacgccgattctgagaaacaactaaagtgagccacatgcgcacagtagttaccggcggtgccggcttcatcggatcccatctcgttgaccttttgatcaaggaaggccacgaggtcgttgtgatcgataacctctcccgcggacgcctggagaatctctccgatgcggaagccaccggaaaactcacctttgtggaagccgatcttctcgacgttgatttcaacgagtttctaggaacccacaagcctgaggttattttccacctggcagcgcaaatcgatgtgcgccactctgttgtagatcctcttcacgacgccgaaaccaacattttgtccaccatccgcatcgctgacgctgcccgccagcacggtgttcgcaaggttgtctttacctcctcaggcggttccatttacggtgagccttcggaattcccagttgatgaaaccgtgccagtggatccacattccccttatgcggcatccaaggtgtccggtgaaatttacctgaacaccttccgccacctgtacggcttagactgttctcacatcgcaccggcaaatgtttacggcccacgccaagatccacacggtgaagcaggagttgtggccattttcgcgctgcgacttctgggaggcctggacaccaaggtattcggcgacggcggaaacacccgcgactacgtctacgtcggtgacgtagttcgtgctttctacctggcttctggggaaatcggtgggggagagcgcttcaacattggcacctctgtggaaacctctgaccgccagctgcacaccctcgtggccactgcggcaggttccaaagatgatcctgaatatgcacctgcacgtctcggcgatgtgccacgcagtgcactcagcttcggcaaggccaaagaggtgcttggttgggagcctgaggtgaacatcgaacaaggtgtggccaagactgtggagtacttccgcactcactaggggaaaatccaccacaaatcgctctga

SEQ ID NO: 28 - protein, 314 aa, Corynebacterium glutamicum
VSHMRTVVTGGAGFIGSHLVDLLIKEGHEVVVIDNLSRGRLENLSDAEATGKLTFVEADLLDVDFNEFLGTHKPEVIFHLAAQIDVRHSVVDPLHDAETNILSTIRIADAARQHGVRKVVFTSSGGSIYGEPSEFPVDETVPVDPHSPYAASKVSGEIYLNTFRHLYGLDCSHIAPANVYGPRQDPHGEAGVVAIFALRLLGGLDTKVFGDGGNTRDYVYVGDVVRAFYLASGEIGGGERFNIGTSVETSDRQLHTLVATAAGSKDDPEYAPARLGDVPRSALSFGKAKEVLGWEPEVNIEQGVAKTVEYFRTH

SEQ ID NO: 29 - DNA, 2041 bp, Corynebacterium glutamicum
  CDS (101)..(2011): RXA00868
cgatgacccagcgcacgcctgggttcgagatacatggaccgggcaagcatttgatgatcgcttgccatatgagaacgcaaacaaggagggataaaatttcatggctgaaacgaagagaatgacagttagccaggcactggttgaattccttggtcaccagtggactgtcgacggcgatatccgcgagcgcaccattccaggcatgttcggaattttcggacacggaaacgttgctggcattggccaggcactcaagcagtacaacgttgaacaacctgagctcatgccgtactaccaggctcgtaatgagcaggcgatggtgcaccagtctgttggatatgcacgcatgcaccgccgtcgtggcacatacgcatctgccgcatctgttggacccggcgcgaccaacctgttaaccggtgcggctcttgctaccaccaaccgtttgccagcgttgctgctgcctagtgatacttttgccacccgcgtggcggatccagtgttgcagcagttggagcagccatgggatatcgggctgacggttaatgatgctttccgccctgtgtctaagttctttgatcgggtgcagcgcccggagcagttgttctctattgcgttggctgcgatgcgtgtgttgactgatcccgcagaaaccggtgcggtcaccattgcgcttccagaagatgtgcaggctgaaatgctcgatgtgccggtggagttcttgcaggatcgtgagtggcacattaggcgcccacgtccagagcgtgctgcgttggctcgtgcgattgaagtcatcaaaaacgctaagaatccgatgatcattgctggtggcggagtgttgtactccgatgcggaaacgcagctgcaggcacttgtggagcagactggcattccagtgggtacctcccaagctggtggtggcgtgttggcgtgggatcatgcacaaaacttaggtggtgtgggtgccaccggaacgttggctgccaaccgcattgcgggtgatgctgatgtgatcatcggtatcggtactcgttacagcgatttcaccaccgcatctcgcactgcgttccaaaaccctgatgtcaccttcatcaacatcaatgttgcttccttcgatgcttacaagcatggcactcagttgcctgtgattgcagatgcacgcgaggcaattgtggagcttgctgaagccctgcagggattcaccgtggcagaggattacgcgcagcgcatcgcgaaggaaaaggctgcgtgggacgcagaagtagataagtcttttgccccctccggtcttgcgctgcctggacagccggagatcatcggcgcggtgcaggcgtcgacaagcgaaaaagacgtcattgtgcaggccgctggatccttgcctggtgacctgcacaagctgtggcgtgtgcgcgatgcgctgggctaccacgtggaatatgcgttctcgtgcatgggctatgaaatcgcgggcggtatcggcgcgaagcgtggacttgatgccgcaggcgatgaccgcgacgtggtgatcatggttggtgatgggtcctacctcatgctcaacactgagctggtcacggccgtggcagaaggtatcaaggtgattgtggtgctcatccaaaaccacggttatgcctccatcggccacctgtctgaaactgtcggttcgcagcgttttggtacttggtaccgcgaatatgacgctgaggcgaaaaacttccagggcgagcagattctgcctgttgacctggcgatgaatgcacgcagctacggcatggatgtcattgaagtggaaccaagcgcgaatgcgatcgaggatctcaaagcagcgatggcaaccgcgaaggcttcggagaaatccaccttcatccacatcaacagcgatccgttgatctacgcaccagacggtgctggttggtgggacgtgccggtgtcggagacgtccactctggatagcaccaacgcggctcgtgaagattacctgaaaaaccaagccctccagcgtccgctgctcggctaaaccagttggctaaaccaaaacgtattt

SEQ ID NO: 30 - protein, 637 aa, Corynebacterium glutamicum
MAETKRMTVSQALVEFLGHQWTVDGDIRERTIPGMFGIFGHGNVAGIGQALKQYNVEQPELMPYYQARNEQAMVHQSVGYARMHRRRGTYASAASVGPGATNLLTGAALATTNRLPALLLPSDTFATRVADPVLQQLEQPWDIGLTVNDAFRPVSKFFDRVQRPEQLFSIALAAMRVLTDPAETGAVTIALPEDVQAEMLDVPVEFLQDREWHIRRPRPERAALARAIEVIKNAKNPMIIAGGGVLYSDAETQLQALVEQTGIPVGTSQAGGGVLAWDHAQNLGGVGATGTLAANRIAGDADVIIGIGTRYSDFTTASRTAFQNPDVTFININVASFDAYKHGTQLPVIADAREAIVELAEALQGFTVAEDYAQRIAKEKAAWDAEVDKSFAPSGLALPGQPEIIGAVQASTSEKDVIVQAAGSLPGDLHKLWRVRDALGYHVEYAFSCMGYEIAGGIGAKRGLDAAGDDRDVVIMVGDGSYLMLNTELVTAVAEGIKVIVVLIQNHGYASIGHLSETVGSQRFGTWYREYDAEAKNFQGEQILPVDLAMNARSYGMDVIEVEPSANAIEDLKAAMATAKASEKSTFIHINSDPLIYAPDGAGWWDVPVSETSTLDSTNAAREDYLKNQALQRPLLG

SEQ ID NO: 31 - DNA, 1606 bp, Corynebacterium glutamicum
  CDS (101)..(1576): RXA00999
cggcctaaaatggttggattttcacctcctgtgacctggtaaaatcgccactacccccaaatggtcacaccttttaggccgattttgctgacaccgggctatgccgtcaagtacgatcaataacatgactaatggagataatctcgcacagatcggcgttgtaggcctagcagtaatgggctcaaacctcgcccgcaacttcgcccgcaacggcaacactgtcgctgtctacaaccgcagcactgacaaaaccgacaagctcatcgccgatcacggctccgaaggcaacttcatcccttctgcaaccgtcgaagagttcgtagcatccctggaaaagccacgccgcgccatcatcatggttcaggctggtaacgccaccgacgcagtcatcaaccagctggcagatgccatggacgaaggcgacatcatcatcgacggcggcaacgccctctacaccgacaccattcgtcgcgagaaggaaatctccgcacgcggtctccacttcgtcggtgctggtatctccggcggcgaagaaggcgcactcaacggcccatccatcatgcctggtggcccagcaaagtcctacgagtccctcggaccactgcttgagtccatcgctgccaacgttgacggcaccccatgtgtcacccacatcggcccagacggcgccggccacttcgtcaagatggtccacaacggcatcgagtacgccgacatgcaggtcatcggcgaggcataccaccttctccgctacgcagcaggcatgcagccagctgaaatcgctgaggttttcaaggaatggaacgcaggcgacctggattcctacctcatcgaaatcaccgcagaggttctctcccaggtggatgctgaaaccggcaagccactaatcgacgtcatcgttgacgctgcaggtcagaagggcaccggacgttggaccgtcaaggctgctcttgatctgggtattgctaccaccggcatcggcgaagctgttttcgcacgtgcactctccggcgcaaccagccagcgcgctgcagcacagggcaacctacctgcaggtgtcctcaccgatctggaagcacttggcgtggacaaggcacagttcgtcgaagacgttcgccgtgcactgtacgcatccaagcttgttgcttacgcacagggcttcgacgagatcaaggctggctccgacgagaacaactgggacgttgaccctcgcgacctcgctaccatctggcgcggcggctgcatcattcgcgctaagttcctcaaccgcatcgtcgaagcatacgatgcaaacgctgaacttgagtccctgctgctcgatccttacttcaagagcgagctcggcgacctcatcgattcatggcgtcgcgtgattgtcaccgccacccagcttggcctgccaatcccagtgttcgcttcctccctgtcctactacgacagcctgcgtgcagagcgtctgccagcagccctgatccaaggacagcgcgacttcttcggtgcgcacacctacaagcgcatcgacaaggatggctccttccacaccgagtggtccggcgaccgctccgaggttgaagcttaaaggctctccttttaacacaacgccaaa

SEQ ID NO: 32 - protein, 492 aa, Corynebacterium glutamicum
MPSSTINNMTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 33 - DNA, 739 bp, Corynebacterium glutamicum
  CDS (101)..(709): RXA01017
gaaatttgagggggcgctacccttagaaggtgcgcaatgacaccacgatagttcgcgcctagtgtggattgctagaaaactttaagaaagaggaaataatatggctcaaaaagtaaccttctggttcgataccacctgcccattctgctgggtcacctcccgctggattaaggaagtcgaacaagtccgcgatattgaaatccagtgggttccaatgagcctcgctgtcctaaacgaaggccgtgatctcccagaggattacaaggagcgcatgaaggctgcatggggaccagcacgcgttttcgcagctgtcgccaccgaccatgctgacaagctcggcgacctgtacaccgcaatgggtacccgcatccacaacgacggtcgcggaccaatcgaaggttccttcaatgatgtcatcgcagaggcacttgaagaggtcggcctagacgctgcacttggtgaagttgcagacaccaccgaatgggacgacgcacttcgcgcattccaccagaccgcaatggacgaggtcggcaacgatgtcggaaccccagtggtcaagctcggcgacaccgctttcttcggcccagtgctcacccgcatcccacgcggcgaggaagcaggagagatcttcgacgcttccttcaagctcgcaagctatccccacttctttgaaatcaagcgcagccgcactgagaacccacagttcgactaattaacgctgtctctgcttattaaacac

SEQ ID NO: 34 - protein, 203 aa, Corynebacterium glutamicum
MAQKVTFWFDTTCPFCWVTSRWIKEVEQVRDIEIQWVPMSLAVLNEGRDLPEDYKERMKAAWGPARVFAAVATDHADKLGDLYTAMGTRIHNDGRGPIEGSFNDVIAEALEEVGLDAALGEVADTTEWDDALRAFHQTAMDEVGNDVGTPVVKLGDTAFFGPVLTRIPRGEEAGEIFDASFKLASYPHFFEIKRSRTENPQFD

SEQ ID NO: 35 - DNA, 1126 bp, Corynebacterium glutamicum
  CDS (101)..(1096): RXA01025
gggcagcagcggcaggtttccaggaggtttccatgcgggtggcttgggacatgggctaacctgagacggttaaatatcgttttcgaaaggtgggtttcgcgtggtttctgtaagcgtgatgggtgcaggttcctggggaaccacgttggccaaggtcttctctgatgctggcaacgctgtgacgttgtgggcgaggcgggaagagttggcaagcaccatccgtgacagccatgaaaaccgtgattaccttccggggattacgttgccggagtcgctgcaggtcacatcatcggcaacggaggctttagagggcgcagccattgtggtgttggcgattccttcgcaggcgttgcgtggcaatttggcggagtggaaagagacgatcccgcaggatgcgaccttggtgtccttggctaaaggtattgaaaagggcacgcacctgcggatgagtgaagtgatcgcggaggtgacggaagcggatccttcacgcatcgcggtgttgtcggggccaaaccttgctcgtgagatcgcggaggggcagcctgcagctacggtgattgcttgccctgatgaaaaccgagcgaaacttgtgcaggctgcagtggctgcgccgtatttccgcccgtacaccaacactgatgtggtgggcactgaaatcggtggtgcgtgtaagaacgtcatcgcgctggcctgtggtatttcccatggttacggcctgggtgagaacaccaatgcatcgttgattactcgtggccttgcagagatcgcacgcctcggtgccacattgggtgcggatgcgaagactttttctggccttgcgggaatgggcgacttggtggctacgtgttcatcaccgctgtcgcgtaaccgcagcttcggtgagcgtttgggtcagggtgaatccctagagaaggctcgcgaggcaaccaatggtcaggttgcggagggtgttatttcctcgcagtcgatttttgatcttgccaccaagcttggtgtggagatgccgatcacccaggctgtctacggtgtgtgccaccgagatatgaaagtaactgacatgattgtggctctcatgggcaggtctaagaaggctgagtagtcttaggttgtaagcttcaatgctgtg

SEQ ID NO: 36 - protein, 332 aa, Corynebacterium glutamicum
VVSVSVMGAGSWGTTLAKVFSDAGNAVTLWARREELASTIRDSHENRDYLPGITLPESLQVTSSATEALEGAAIVVLAIPSQALRGNLAEWKETIPQDATLVSLAKGIEKGTHLRMSEVIAEVTEADPSRIAVLSGPNLAREIAEGQPAATVIACPDENRAKLVQAAVAAPYFRPYTNTDVVGTEIGGACKNVIALACGISHGYGLGENTNASLITRGLAEIARLGATLGADAKTFSGLAGMGDLVATCSSPLSRNRSFGERLGQGESLEKAREATNGQVAEGVISSQSIFDLATKLGVEMPITQAVYGVCHRDMKVTDMIVALMGRSKKAE

SEQ ID NO: 37 - DNA, 1528 bp, Corynebacterium glutamicum
  CDS (101)..(1498): RXA01175
gggtaaaagggatcgcgtctcttagtcgatctgctcccattccataggttgggagaaaacttaactgttattccattccttaaaacaccgatatcgtgctatgaataggggtgtgagttggacagttgatatccctaaagaagttctccctgatttgccaccattgccagaaggcatgcagcagcagttcgaggacaccatttcccgtgacgctaagcagcaacctacgtgggatcgtgcacaggcagaaaacgtgcgcaagatccttgagtcggttcctccaatcgttgttgcccctgaggtacttgagctgaagcagaagcttgctgatgttgccaacggtaaggccttcctcttgcagggtggtgactgtgcggaaactttcgagtcaaacactgagccgcacattcgcgccaacgtaaagactctgctgcagatggcagttgttttgacctacggtgcatccactcctgtgatcaagatggctcgtattgctggtcagtacgcaaagcctcgctcttctgatctggatggaaatggtctgccaaactaccgtggcgatatcgtcaacggtgtggaggcaaccccagaggctcgtcgccacgatcctgcccgcatgatccgtgcttacgctaacgcttctgctgcgatgaacttggtgcgcgcgctcaccagctctggcaccgctgatctttaccgtctcagcgagtggaaccgcgagttcgttgcgaactccccagctggtgcacgctacgaggctcttgctcgtgagatcgactccggtctgcgcttcatggaagcatgtggcgtgtccgatgagtccctgcgtgctgcagatatctactgctcccacgaggctttgctggtggattacgagcgttccatgctgcgtcttgcaaccgatgaggaaggcaacgaggaactttacgatctttcagctcaccagctgtggatcggcgagcgcacccgtggcatggatgatttccatgtgaacttcgcatccatgatctctaacccaatcggcatcaagattggtcctggtatcacccctgaagaggctgttgcatacgctgacaagctcgatccgaacttcgagcctggccgtttgaccatcgttgctcgcatgggccacgacaaggttcgctccgtacttcctggtgttatccaggctgttgaggcatccggacacaaggttatttggcagtccgatccgatgcacggcaacactttcaccgcatccaatggctacaagacccgtcacttcgacaaggttatcgatgaggtccagggcttcttcgaggtccaccgcgcattgggcacccacccaggcggaatccacattgagttcactggtgaagatgtcaccgagtgcctcggtggcgctgaagacatcaccgatgttgatctgccaggccgctacgagtccgcatgcgatcctcgcctgaacactcagcagtctttggagttggctttcctcgttgcagaaatgctgcgtaactaagcttttagaccaactctaaaaaagcta

SEQ ID NO: 38 - protein, 466 aa, Corynebacterium glutamicum
MNRGVSWTVDIPKEVLPDLPPLPEGMQQQFEDTISRDAKQQPTWDRAQAENVRKILESVPPIVVAPEVLELKQKLADVANGKAFLLQGGDCAETFESNTEPHIRANVKTLLQMAVVLTYGASTPVIKMARIAGQYAKPRSSDLDGNGLPNYRGDIVNGVEATPEARRHDPARMIRAYANASAAMNLVRALTSSGTADLYRLSEWNREFVANSPAGARYEALAREIDSGLRFMEACGVSDESLRAADIYCSHEALLVDYERSMLRLATDEEGNEELYDLSAHQLWIGERTRGMDDFHVNFASMISNPIGIKIGPGITPEEAVAYADKLDPNFEPGRLTIVARMGHDKVRSVLPGVIQAVEASGHKVIWQSDPMHGNTFTASNGYKTRHFDKVIDEVQGFFEVHRALGTHPGGIHIEFTGEDVTECLGGAEDITDVDLPGRYESACDPRLNTQQSLELAFLVAEMLRN

SEQ ID NO: 39 - DNA, 1237 bp, Corynebacterium glutamicum
  CDS (101)..(1207): RXA01350
agctgacaactataaatggtgcccgatatcaggaaaaattgcttgcacaccgcgccgattccccatgatgccctaacatcttgcaggtgaggggtacatattggggcaattcgggggtaattttgcagtatcgtcaagatcacccaaaactggtggctgttctcttttaagcgggatagcatgggttcttagaggaccccctacaaggattgaggattgtttaatgaattccccgcagaacgtctccaccaagaaggtcaccgtcaccggcgcagctggtcaaatctcttattcactgttgtggcgcatcgccaacggtgaagtattcggcaccgacacccctgtagaactgaaacttctggagatccctcaggctcttggcggggcagagggtgtggctatggaacttctggattctgccttccccctcctgcgaaacatcaccatcaccgcggatgccaatgaggcattcgacggcgctaatgcggcgtttttggtcggtgcgaagcctcgcggaaaaggcgaagagcgcgcagatttgctggctaacaacggcaagattttcggacctcaaggtaaagctatcaatgacaacgccgcagatgacattcgtgtcctagttgttggaaacccagcgaacaccaacgcgttgattgcttcagctgcggccccagatgttccagcatcccgcttcaacgcaatgatgcgccttgatcacaaccgtgcgatctcccagctggccaccaagcttggccgtggatctgcggaatttaacaacattgtggtctggggaaatcactccgcaacccagttcccagacatcacctacgcaaccgttggtggagaaaaggtcactgacctggttgatcacgattggtatgtggaggagttcattcctcgcgtggctaaccgtggcgctgaaatcattgaggtccgtggaaagtcttctgcagcttctgcagcatcctctgcgattgatcacatgcgcgattgggtacagggcaccgaggcgtggtcctctgcggcaattccttccaccggtgcatacggcattcctgagggcatttttgtcggtctgccaaccgtatcccgcaacggtgagtgggaaatcgttgaaggcctggagatttccgatttccagcgcgcccgcatcgacgcgaatgctcaggaattgcaggccgagcgcgaggcagtgcgcgacttgctctaatctttaacgcatgacttcgcttttcga

SEQ ID NO: 40 - protein, 369 aa, Corynebacterium glutamicum
LGQFGGNFAVSSRSPKTGGCSLLSGIAWVLRGPPTRIEDCLMNSPQNVSTKKVTVTGAAGQISYSLLWRIANGEVFGTDTPVELKLLEIPQALGGAEGVAMELLDSAFPLLRNITITADANEAFDGANAAFLVGAKPRGKGEERADLLANNGKIFGPQGKAINDNAADDIRVLVVGNPANTNALIASAAAPDVPASRFNAMMRLDHNRAISQLATKLGRGSAEFNNIVVWGNHSATQFPDITYATVGGEKVTDLVDHDWYVEEFIPRVANRGAEIIEVRGKSSAASAASSAIDHMRDWVQGTEAWSSAAIPSTGAYGIPEGIFVGLPTVSRNGEWEIVEGLEISDFQRARIDANAQELQAEREAVRDLL

SEQ ID NO: 41 - DNA, 1207 bp, Corynebacterium glutamicum
  CDS (101)..(1177): RXA01392
gtctgcaatcaccccgaacatttgttcaatcgttgattttcattccacttcgtaatattgttgacatatcatctaaatttccaagagaggacaccacacagtggctaacacgtcatccgattgggcaggcgccccacaaaatgcatcagcagacggcgagttcgttcgcgataccaactacatcgatgaccgcatcgtcgcagacgttccagcgggatccgaaccaattgctcaggaagatggcactttccattggcctgtcgaggctggtcgctaccgtttagtcgctgcccgcgcatgtccatgggcacaccgcactgttatcacccgtcgtcttctcggcctggagaacgtgatctcgcttggtctgaccggcccgactcacgacgttcgttcctggactttcgatttagatccaaaccatcttgatcccgtgctgcagattcctcgtctacaggacgcgtatttcaaccgcttccccgattacccgcgcggcattactgtcccagcgctcgtggaggaatcgtctaagaaggtcgtcaccaacgattacccttccatcaccatcgatttcaatcttgagtggaagcagttccaccgtgagggtgcgcctaacctctaccccgcggagctgcgcgaggagatggcgccggtgatgaagcgcatcttcactgaggtcaacaacggcgtatacaggaccggctttgccggtagccaggaagcgcacaacgaggcgtacaagcggctttgggttgcgttggactggctagaagatcgcttatcgacgcgacgttacctcatgggggatcacatcaccgaggcggatatccgcctctacccaaccctcgtgcgtttcgatgccgtctaccacggacacttcaagtgtggccgcaacaagatcaccgaaatgccgaatctatggggctacctgcgggatcttttccagaccccaggctttggcgacaccaccgatttcaccgaaatcaagcagcactactacatcacccacgcggagattaaccccacccggatcgttccagtcggaccagatctgtctggtttcgcgacaccacacggccgtgaaaagctcggcggatccccatttgctgaaggtgttactctgcctggcccaattcctgcgggcgaagaagtgaaaaaccctgaaccttttcagaagtaactaaggccgcaatccctcgattgctgc

SEQ ID NO: 42 - protein, 359 aa, Corynebacterium glutamicum
VANTSSDWAGAPQNASADGEFVRDTNYIDDRIVADVPAGSEPIAQEDGTFHWPVEAGRYRLVAARACPWAHRTVITRRLLGLENVISLGLTGPTHDVRSWTFDLDPNHLDPVLQIPRLQDAYFNRFPDYPRGITVPALVEESSKKVVTNDYPSITIDFNLEWKQFHREGAPNLYPAELREEMAPVMKRIFTEVNNGVYRTGFAGSQEAHNEAYKRLWVALDWLEDRLSTRRYLMGDHITEADIRLYPTLVRFDAVYHGHFKCGRNKITEMPNLWGYLRDLFQTPGFGDTTDFTEIKQHYYITHAEINPTRIVPVGPDLSGFATPHGREKLGGSPFAEGVTLPGPIPAGEEVKNPEPFQK

SEQ ID NO: 43 - DNA, 1321 bp, Corynebacterium glutamicum
  CDS (101)..(1291): RXA01436
gcctaaacaaaccagtcaacgacctttcccgtggcgcaacagtccctgacatcgtcaacacagtagccatcacagcaattcaggcaggaggacgcagctaatggcattggcacttgttttgaactccggttcatcttccatcaaattccagctggtcaaccccgaaaactctgccatcgacgagccatatgtttctggtcttgtggagcagattggtgagccaaacggccgcatcgtactcaaaatagagggtgaaaaatataccctagagacacccatcgcagatcactccgaaggcctaaacctggcgttcgatctcatggaccagcacaactgtggtccttcccaactggaaatcaccgcagttggacaccgcgtggtccacggcggaatcttgttctccgcaccggaacttatcactgatgaaatcgtggaaatgatccgcgatctcattccactcgcaccactgcacaaccctgcaaacgttgacggcattgatgttgctcgaaaaattctccccgatgtcccacacgtagctgtctttgacaccggtttcttccactcacttccaccagcagctgcgctgtatgccatcaacaaggatgtcgcagctgaacacggaatcaggcgctatggtttccacggcacctcccatgaatttgtgtccaagcgcgtggtggaaattctggaaaagcccaccgaagacatcaacaccatcaccttccacctgggcaacggcgcatccatggctgctgttcaaggtggccgtgcggtagatacttccatgggtatgacacctctcgcgggccttgtcatgggtacccgaagcggtgacattgatccaggtatcgtcttccacctttcccgcaccgctggcatgagcatcgatgagatcgataatctgctgaacaaaaagtcgggtgtaaagggactttccggtgttaatgatttccgtgaactgcgggaaatgatcgacaacaatgatcaagatgcctggtccgcgtacaacatttacatacaccaactccgccgctacctcggttcctacatggtggcactgggacgggtagacaccatcgtgttcaccgccggtgtcggtgaaaatgcccagtttgtccgtgaggatgccttggcaggtttggaaatgtacggaattgagatcgatccagagcgtaacgcattgccaaacgatggtcctcgattgatttccaccgatgcctccaaggtgaaggtgtttgttattccaactaatgaagagttagctatcgctaggtacgcggtgaagttcgcttagctctcctggttaggatccaccacaaat

SEQ ID NO: 44 - protein, 397 aa, Corynebacterium glutamicum
MALALVLNSGSSSIKFQLVNPENSAIDEPYVSGLVEQIGEPNGRIVLKIEGEKYTLETPIADHSEGLNLAFDLMDQHNCGPSQLEITAVGHRVVHGGILFSAPELITDEIVEMIRDLIPLAPLHNPANVDGIDVARKILPDVPHVAVFDTGFFHSLPPAAALYAINKDVAAEHGIRRYGFHGTSHEFVSKRVVEILEKPTEDINTITFHLGNGASMAAVQGGRAVDTSMGMTPLAGLVMGTRSGDIDPGIVFHLSRTAGMSIDEIDNLLNKKSGVKGLSGVNDFRELREMIDNNDQDAWSAYNIYIHQLRRYLGSYMVALGRVDTIVFTAGVGENAQFVREDALAGLEMYGIEIDPERNALPNDGPRLISTDASKVKVFVIPTNEELAIARYAVKFA

SEQ ID NO: 45 - DNA, 2056 bp, Corynebacterium glutamicum
  CDS (101)..(2026): RXA01478
tggcagagcattcgactgttaatcgaagggtcactggttcgagcccagttggaggagcaatacacacagcccgccgtttttcttaaaacggcgggttttgttgtggaggggcgcgtcgaaaagcaattttttttccaagatagctcactttattggagtcacctggcctgaaatcctctactctgggcgcatgaccattccaggagcttccacacagactgatatccctctggacacacttcttgaggattacgcgctactgtcagacactcacaccggcgctctgctgtccaacatgggcagtttggactggttgtgcctgcctcgttttgattcccaagccatgttcaccaggctgcttggtgatcgcgagcacggacactggagtttgcgtgtcccaggtggtgaggtgatcagccaaaactacctcggcgattccttcgtggtgcagaccgtgtggcgttcagagaccggtactgcccgggttgttgatttcatgccaattcacggtcaagaacaacccgatatcaccgacctggtgcgctctgtgcactgcgtggaaggcgaagtggatgtggaatcgatcctgcgcctgcgttttgattatggcgagtccactccgtatttccgcaccagcactgtcgacggcatcagcatcgtgcaggctgtcgccggccccaatgcggtatatgttcgtggacctgagatgccacaccgccctgcaaaggattgtcacagtggcaccttccacctgacggccggcgaatccgtggaatgggttctcacctgggcaccgtcgttcgaaccgcatccccccatgccggattacacccgctctttggagagcaccttgagcttctgggcatcatgggttgaagagctcccccaccagcgcctctacgacgctgaagtccgccgctccatgctcgtactgcgcgccttgaccgatctacaaaccggtggcatcgtggccgcaccgaccacctcactaccagaggatttcggaggcatccgtaactgggactaccgctacgtgtggctgcgcgactccgcactcaccattgaagccctcgtggaatacggattctcccaagcagccctccaatggcgcacctggctgctgcgcgccatcgcaggcgacccggaaaacctccgcatcatgtatggcctcggcggcgaacgacacctccctgaacgcgaactccaacacctgcgcggatacgaaaactccgtgcctgttcgcgttggcaatggagccgccgaacaataccaagcagatgtcgtcggcgaagtaatggtcgcgcttgaaaccatccgccgcgccgggtgcctcgaggacgaattctcctggggcatgcaaaaagccatcctcgatttccaagaagccaacttcgaccgcaaggatcaaggcatctgggaaatgcgctccgaaccgcaatatttcacccacggccgcgccatgatgtgggccggcttcgaccgcggcatcaaagccatcgaagaattcaacctcgacggccccatcgagcgctggcgtgaactccgcgccaaactccgcgaagaaatcatgaccaacggcttcaacgaagagatccaatccttcacccagtgctacgacaacacccaagtcgacgcctcgctgcttcagctcgcccaaataggcttcatcggcttcgacgatccaaaaatgctcagcaccgtagcgcgcattgagcaagagcttctcgacgcccacggctttcttcacaggtaccacaccgacgggtctgacggccttgccggcgacgaataccccttcctcatctgttcattctggctggtagaacaatacgcaagctccaaccgcctcgacgaggccaaagaaaagatgaaccgcatccttgccgtccaaagcccacttggcctactggctgaggaatactccacccaccatggcaggctcgctggaaactaccctcaggccttttcccacattggtctgatcagcgctgcccgtgccataaatttcgaagaagcgcgaaacaggtagagtctaaggtgtcattcttggtacaag

SEQ ID NO: 46 - protein, 642 aa, Corynebacterium glutamicum
LWRGASKSNFFSKIAHFIGVTWPEILYSGRMTIPGASTQTDIPLDTLLEDYALLSDTHTGALLSNMGSLDWLCLPRFDSQAMFTRLLGDREHGHWSLRVPGGEVISQNYLGDSFVVQTVWRSETGTARVVDFMPIHGQEQPDITDLVRSVHCVEGEVDVESILRLRFDYGESTPYFRTSTVDGISIVQAVAGPNAVYVRGPEMPHRPAKDCHSGTFHLTAGESVEWVLTWAPSFEPHPPMPDYTRSLESTLSFWASWVEELPHQRLYDAEVRRSMLVLRALTDLQTGGIVAAPTTSLPEDFGGIRNWDYRYVWLRDSALTIEALVEYGFSQAALQWRTWLLRAIAGDPENLRIMYGLGGERHLPERELQHLRGYENSVPVRVGNGAAEQYQADVVGEVMVALETIRRAGCLEDEFSWGMQKAILDFQEANFDRKDQGIWEMRSEPQYFTHGRAMMWAGFDRGIKAIEEFNLDGPIERWRELRAKLREEIMTNGFNEEIQSFTQCYDNTQVDASLLQLAQIGFIGFDDPKMLSTVARIEQELLDAHGFLHRYHTDGSDGLAGDEYPFLICSFWLVEQYASSNRLDEAKEKMNRILAVQSPLGLLAEEYSTHHGRLAGNYPQAFSHIGLISAARAINFEEARNR

SEQ ID NO: 47 - DNA, 2272 bp, Corynebacterium glutamicum
  CDS (101)..(2242): RXA01554
tggcttaaaccttatttgtagttgtcaataaatatgaaattccttagcaacttgtttaaatagacgtataaacaagtttgaaaaaggaaggttatccatcttgaaaaagcatgtgacctcagccgttaccgccgtggtgacggctttttcaacggctgcgcttggtttaagtattgccgtttctcctgctgttgcccaagtggctaatccagctccagatctttctgcgccgtatacatgggtggaagagtttgattccgaggatgctctcaaagggtggaacattttccgccagccagattatggcagcgacaaagttctctataccgaagatgctttaagtatcgaagatggcaagctcaccatcaccactcagcgccactgcgttgacgaagacttcgcgatcagtgatcctgtcaaccgcggaaagctcaatgacagcaccgcgcaagttgaaccttgtgctccaggtcagtttgaaaagttcaccagtgcgcgcatcgtcactccgaaaattgctcgtggagagttcgacctttctgtcactgcaactcttaacaccggtggcgtcgaaggtgtccgaagtgccatttggatgcaaaacggtgaacaggcgtgttcctcagcaaccaacaatggcctctacggagaactagacctggtagagcacttttcttacgatcttcgctcgccatggtctccatcaaacacccacttgggttgtgatcctgaaagtgtcaacggcaccaaccgtgcacctcgtgaacttaaactagatgagtcactcgatggcgtggagcacacctggactgtgagcaccacccgcgacggcgttgagtacttcattgatgatgaggcgattaaccgccagtcatggcgcaacgatgtcactttggggcatgccgaaattgatgatttcgggatctccgcgcagacgtttgatgagatcgtcgaccgcgaatggactctcactcttaatcaaaaggtagaaagcgccgactgggcaaaaccacgttcctctgaggaagatttcccagtccggtccatggtgattgaccgcatcgaggtcaccggatctcccgcagtatctgaagacacccccatgccagataccacccagcttttgacccaagacactctggaatacctcggtcgcatgccagtgctggaacgctacgagccagcaagtgctgattttgccgatggccgcaggccttcctggaactacttcaatttgaaggaatcgtggcagaatccagaactcgagcaacgcccagaagctgtcgaattcgttgatggacgcatggatatcgtgacccgtcgccactgtctggccaccactgatgacatcgccactccggaaaacgcacaggaggaaccgtgcgcgccgggtgaggtgacacgctacagctcagcgcgtgtccaccttccagagatccccgccggcaacttccggctcaccgtgcgcgcacgggcgcagtccgaagagcttgtcgacggcgtccgccccgctatctggatgcagaacaataccaacttctgtgctgacaacgatggacgcccttatggtgaactggatattactgagttctacagctctcgtgtgaacacccagtactcggcagtacaccttggatgtgctggcaaccgcccagagatgaagcttcgccaaatggaaatggaagagtccatgtttggggattggcatgactggggcgtcgaagtcttcgacggccagatcgtattcaccattgacggcaaggcagtaacttcctctggcaaagatgtctttggcaactctgttaccccagccgctgcacctcttcgccccgcgcacttcaagttgtcggaagaggaataccgtgaagtcatcgggcagccttggcaccttattttgaacaccatggtggagcagtctggcaaagacagctggattacagcggtcgacaataacgaggcgttcccagaacaccgcttccaaattgaccatgtggcagtagatatcgagtctgactctgtggacaatgtatggcctgacgctgcgaatgaaatcccagacaatgttggtattgaagactctgatgatggcagcgacctggaggttggttcgaccggaagctctacagctgagaccgtgagctggatctcgttgttcaccgcgttgagctcgctggtcttcacactggctctcaatcaagaagcattgcagaatttgattaatcagttcatgagacagttcaagtaatccttgtgggcgctttgtctacttcac

SEQ ID NO: 48 - protein, 714 aa, Corynebacterium glutamicum
LKKHVTSAVTAVVTAFSTAALGLSIAVSPAVAQVANPAPDLSAPYTWVEEFDSEDALKGWNIFRQPDYGSDKVLYTEDALSIEDGKLTITTQRHCVDEDFAISDPVNRGKLNDSTAQVEPCAPGQFEKFTSARIVTPKIARGEFDLSVTATLNTGGVEGVRSAIWMQNGEQACSSATNNGLYGELDLVEHFSYDLRSPWSPSNTHLGCDPESVNGTNRAPRELKLDESLDGVEHTWTVSTTRDGVEYFIDDEAINRQSWRNDVTLGHAEIDDFGISAQTFDEIVDREWTLTLNQKVESADWAKPRSSEEDFPVRSMVIDRIEVTGSPAVSEDTPMPDTTQLLTQDTLEYLGRMPVLERYEPASADFADGRRPSWNYFNLKESWQNPELEQRPEAVEFVDGRMDIVTRRHCLATTDDIATPENAQEEPCAPGEVTRYSSARVHLPEIPAGNFRLTVRARAQSEELVDGVRPAIWMQNNTNFCADNDGRPYGELDITEFYSSRVNTQYSAVHLGCAGNRPEMKLRQMEMEESMFGDWHDWGVEVFDGQIVFTIDGKAVTSSGKDVFGNSVTPAAAPLRPAHFKLSEEEYREVIGQPWHLILNTMVEQSGKDSWITAVDNNEAFPEHRFQIDHVAVDIESDSVDNVWPDAANEIPDNVGIEDSDDGSDLEVGSTGSSTAETVSWISLFTALSSLVFTLALNQEALQNLINQFMRQFK

SEQ ID NO: 49 - DNA, 2038 bp, Corynebacterium glutamicum
  CDS (101)..(2008): RXA01562
gcaggtgcacatttgttttgtcacctgcacaaaagtgtcgccagcccgatacttgtacaaccgtccgcatccgagaagcaaaggtgtctgactcgcgccaatgggaattctgaacagtatttcaacacctgctgacttaaaggcccttaatgatgaggatttggacgctcttgccaaagaaatccgaactttcctggtcgataaagtcgcagcaactggtggccacttaggtccaaatttgggcgtagtggaattaaccatcggtcttcatcgagttttcgattcgcctcaagacccgatcatctttgatacttctcaccagtcctatgtgcataagatcctgacgggtcgcgctaaagattttgattctttgcgtcaaaaagatggcctttctggttacacctgccgtgctgaaagtgagcacgattggactgagtcttcgcatgcttcggcggccttgtcttatgcggatggtttgtctaaagccaagcagttggatggcgataccacgcatagtgtggttgctgtcgttggtgatggcgctctaactggcggcatgtgttgggaagcactgaacaatattgctgctggtaaagaccgcaaagttgttgtcgtagtcaatgacaatggccggagttattctccaaccattggcggatttgcggaaaaccttgcgggccttcgcatgcagcctttctatgatcgcttcatggaaaagggcaagacgtccctgaaatccatggggtgggtaggggagcgtacttttgaagcgctccatgcatttaaagaaggtgtgaagagcaccgtcattcccaccgaaatgttccctgaactgggcatgaaatacgtgggtccggttgatggacataaccaaaaagctgtcgacaatgcgctgaaatacgctcatgattatgatggccccatcatcgtgcacatggtcaccgaaaagggtcgtggttacgcgcctgctgagcaggatttggacgaattgatgcactccacgggcgtcatcgatccgctcacaggagctcctaaatctgcatcaaagcccggttggacctctgtgttcagcgatgagctggtcaagattggtgcgcagaatgaaaacgttgttgccatcaccgccgcgatggcaggtcctaccggtctgtccaagttcgaagccaatttccccaaccgattctttgatgtcggcattgctgagcagcacgcggtaacttctgccgcaggcctcgcattgggtggaaaacaccctgtggtggctatttactccacgttcttgaaccgcgcttttgatcagctgctcatggatgtgggcatgctcaaccagcctgttactttggtgcttgatcgctcaggtgtcacgggttcggatggagcgagccacaatggcgtctgggatatggcgctgacctcgatcgttccaggcgtgcaggtggcggcaccacgtgatgaggattccttgcgtgagctgctcaatgaggctatttccatcgatgatggccccacagttgtgcgtttccccaagggcgacttgccaactccaattgttgctatcgacaccttggaagacggcgtggatgtcctcgcatatgaagacgccactgacgttgaatcaaccgacgatgcgccatcagttctcatcattgcggtaggcgagcgcgcaactgttgcacttgacgttgcttccaggattaaacagcacggcgtgaacgtcacggttgttgacccccgctggattgtccccatcccgcagtccttggtcgcgctgtctgatgatcatgacctcgtgatcaccatcgaagacggcgtcatccacggcggcgtgggatccttgctctctgatgcgcttaacgcctctgaggtggatacccctcgccgacaaatcgccgtgccccagaagtacctggatcacgcgtcccgcaatgaagtgctcgccgattatggcctcgacgccgacggcattgaaaccactgttgttggatggctggattccctgttcggggaataaaaccctgcttatcgacgccgccctcca

SEQ ID NO: 50 - protein, 636 aa, Corynebacterium glutamicum
MGILNSISTPADLKALNDEDLDALAKEIRTFLVDKVAATGGHLGPNLGVVELTIGLHRVFDSPQDPIIFDTSHQSYVHKILTGRAKDFDSLRQKDGLSGYTCRAESEHDWTESSHASAALSYADGLSKAKQLDGDTTHSVVAVVGDGALTGGMCWEALNNIAAGKDRKVVVVVNDNGRSYSPTIGGFAENLAGLRMQPFYDRFMEKGKTSLKSMGWVGERTFEALHAFKEGVKSTVIPTEMFPELGMKYVGPVDGHNQKAVDNALKYAHDYDGPIIVHMVTEKGRGYAPAEQDLDELMHSTGVIDPLTGAPKSASKPGWTSVFSDELVKIGAQNENVVAITAAMAGPTGLSKFEANFPNRFFDVGIAEQHAVTSAAGLALGGKHPVVAIYSTFLNRAFDQLLMDVGMLNQPVTLVLDRSGVTGSDGASHNGVWDMALTSIVPGVQVAAPRDEDSLRELLNEAISIDDGPTVVRFPKGDLPTPIVAIDTLEDGVDVLAYEDATDVESTDDAPSVLIIAVGERATVALDVASRIKQHGVNVTVVDPRWIVPIPQSLVALSDDHDLVITIEDGVIHGGVGSLLSDALNASEVDTPRRQIAVPQKYLDHASRNEVLADYGLDADGIETTVVGWLDSLFGE

SEQ ID NO: 51 - DNA, 1489 bp, Corynebacterium glutamicum
  CDS (101)..(1459): RXA01569
aaggcctagagcagaccatcgattggtaccgcgaaaacgaggcctggtggcgccctgccaagaacaacgtcgaagctacctacgctaagcagggacaataatggaatacggtaaacaactcacctcccacaccaccgacatcgaaggcctactggttttcgatttccccgtccacggcgacaaccgcggctggttcaaggaaaattggcagcgcaccaagatgaccaacctggggctgcccgattttggccccgtccaaaacaacatgagtttcaacgccaccgccggcacgactcgcggcatgcacgctgagccgtgggataaatttgtgtccgtcgcggtgggttccgttttcggagcttgggtggatctgcgcgcgggctcgagcacgtacggtaacgtcgtaacgcaaaaaattacccctgacgtgggagtttacgtcccgcgtggtgtggcaaacggcttccaggcgctcgaggacggcacgctgtacacctacctcgtcaacgatcattggtcccccgacgcgcattacgccaacgtcaacctcaacatgatcgactggccgctgcccatcaccgagatctccgaaaaagataaaaaacatccagcgcttatcgacgccacccccctgcccgcccgcaaggttctcgtggtcggcgccggcggacaactgggaaccgcgctacgcgcgcagttcccagacgcggaatttgtcacgcgccaagaactcgatatcacctcagatctcaccgaggctcgcgcgtggaaacaatactccaccatcataaacgccgccgcctacactgccgttgaccaggcagaacacgaccgcgcagcagcgtgggacatcaacgcagcggcagtggctaacctcgcgaccatcgcgcgcgacaacaacctcaccctcgtgcacgtgtcctcagattatgtcttcgacggtgcggccgaatcctacgatgaaaacgcaccgttttccccactcggcgtgtacggccaatccaaagcagccggcgacatcgcagccaccaccgcaccgcgccactacattgtgcgcaccagctgggtgattggcgatggcaataattttgtccgcaccatgaaatccctcgacgaacgcggcatcgcaccatcagtagttgatgatcaaatcggccgcctatccttcaccgaagacatcgcagccggcatcgcgcaccttttggaagtgggtgcagcatatggcacctacaacctcaccaacaccggcgaacccgcaagctgggccgatgttgcccgcgcagtattttccgaccccaccaaagttaccggcgtgagcaccgccgagtacttcgccaacaaagacgcagcgccccgcccactgaactccgttttggatctcggcaaaatcgaagccaccggatttagcgcaccgacctggcagacccgcctcaacgactacctcaaggaactctcaaagtgaaaggcatcatcctcgcaggtggctccg

SEQ ID NO: 52 - protein, 453 aa, Corynebacterium glutamicum
MEYGKQLTSHTTDIEGLLVFDFPVHGDNRGWFKENWQRTKMTNLGLPDFGPVQNNMSFNATAGTTRGMHAEPWDKFVSVAVGSVFGAWVDLRAGSSTYGNVVTQKITPDVGVYVPRGVANGFQALEDGTLYTYLVNDHWSPDAHYANVNLNMIDWPLPITEISEKDKKHPALIDATPLPARKVLVVGAGGQLGTALRAQFPDAEFVTRQELDITSDLTEARAWKQYSTIINAAAYTAVDQAEHDRAAAWDINAAAVANLATIARDNNLTLVHVSSDYVFDGAAESYDENAPFSPLGVYGQSKAAGDIAATTAPRHYIVRTSWVIGDGNNFVRTMKSLDERGIAPSVVDDQIGRLSFTEDIAAGIAHLLEVGAAYGTYNLTNTGEPASWADVARAVFSDPTKVTGVSTAEYFANKDAAPRPLNSVLDLGKIEATGFSAPTWQTRLNDYLKELSK

SEQ ID NO: 53 - DNA, 1552 bp, Corynebacterium glutamicum
  CDS (101)..(1522): RXA01693
aggagactggctggattattggctggttttcttgggaaatcgtcatgggcattaatcctagtcccaacaattgccagaacccgaacactaggcttgaaccatgaatactgcacctttcaaactcgaagctgacttcgcatcagccctgcccaccatggcagccccctggcaaggtgaggaagcccccaaccctgagctcgtgattttaaatgacgacctcgcctacagcctcgggcttgatccgacatggcttcgcacacctgagggcgttcaatttcttctcggactcaaccccgagcccttaacaaaagcagttgcgcaggcctattccggccaccaattcggacagtttgtggcaagccttggtgatggccgagcgcttcttctcggcgaagcccgctcagctgacggcgtactgcatgatatccacctcaaaggatctggacgaacccaattctcccgaggagccgatggacgcgccgtccttggccccgtcttacgcgaatacatcatctccgaagcgatgcatgcacttggtgttcccaccaccaggtcacttgcagtaattagcaccggtaggaaaatccaacgaggaagcgtagccccaggcgcagtccttgttcgagtagcaaccagcctcattcgagtcggatccttccaatactccaacatctctggtggcatcgaactatctcaacacctggcgaactatacgatcaccaggcatttcccttcgttggtagctgaactatccgcaccaacccccgcaacttatgtatcactgtttaaagcgattcttcagcgccaagcagacaccgttggaaaatggaccaggctgggtttcgttcacggagccctcaacacagacaacacgttgatatccggagaaactgttgactacggcccatgcgctttcatggagcgctaccgtggcgacgcgaaatttagctccatcgacacttatggtcgctacaaatttgaaaaccaacctatgatcctcggatggaacatggcccgcctcgtagaaaccctcctcccactcctgggcgccacaccagacgaaggcatgacagcagcccaagaagctctcgtagaattcgatgacctctgcgaacaagcaatccgaaaagaattcgccactgcactgggccttgacgagtcagacaccggcacggtagagcagttccgtgaactgctctacctccataaccccgacatcaccacgctgctgcgcgcactcaccgacaacaccgcaccaccgagtggctttgaagcattcgttcacgactggaaaacccaagacccagatatcgaagcaatgcgagcagtaaatccacttttcattccacgcaatcacctcgtggaagctgctctcgcagacgcagttgaagggaatctagaaaagttccacgaactcctcgctgctgtcaccaatccttttgatccaactgcgggccccgatgaactacgcctgccaagcgaagaaggatttgaagaagactacatgaccttctgcggtacctaggacagatggtggggcagacgtcggggt

SEQ ID NO: 54 - protein, 474 aa, Corynebacterium glutamicum
MNTAPFKLEADFASALPTMAAPWQGEEAPNPELVILNDDLAYSLGLDPTWLRTPEGVQFLLGLNPEPLTKAVAQAYSGHQFGQFVASLGDGRALLLGEARSADGVLHDIHLKGSGRTQFSRGADGRAVLGPVLREYIISEAMHALGVPTTRSLAVISTGRKIQRGSVAPGAVLVRVATSLIRVGSFQYSNISGGIELSQHLANYTITRHFPSLVAELSAPTPATYVSLFKAILQRQADTVGKWTRLGFVHGALNTDNTLISGETVDYGPCAFMERYRGDAKFSSIDTYGRYKFENQPMILGWNMARLVETLLPLLGATPDEGMTAAQEALVEFDDLCEQAIRKEFATALGLDESDTGTVEQFRELLYLHNPDITTLLRALTDNTAPPSGFEAFVHDWKTQDPDIEAMRAVNPLFIPRNHLVEAALADAVEGNLEKFHELLAAVTNPFDPTAGPDELRLPSEEGFEEDYMTFCGT

SEQ ID NO: 55 - DNA, 1792 bp, Corynebacterium glutamicum
  CDS (101)..(1762): RXA01814
tgttaagccaccctactccgtgaattttgccgtatctcgtgcgcacaattgcttttgaggggaagatgaagagaaagtattggtgttttaaggagcaaacatggcacatgaacgcgccgggcaactcgcccaaccagaagatctcatcgatgttgcggaactggtcaccgcatatttcacccgcaagccggacgtgaacaaccctgatcagcaggtcgctttcggcacctccggacaccgtggctccgcgctggacagcgctttcaacgaggaccacatcctggcaaccacccaggcgatcgtcgactaccgcaaccagcagccaaaaaactgggtcggcccgctgtttatcggccgcgatacgcacgcgctgtccgaaccagcgatgatcagcgcgcttgaggtcctcattgccaacgacgtcgaagtgcttgtcgacgccgacggccgctacaccccgacgcccgcagtgtcccacgcgatcctacgacacaacgatggcatcatccttggcaccgcaggaccctcccgcccctacgccgacggcatcgtgatcaccccatcccacaaccctcctcgtgatggcggattcaaatacaacccagccaacggtggccctgcagataccgacgccaccgactggatcgccaaccgcgccaacgatattctgcgcggcgaccttgcagacgtgaagcgagttccagtttccggtgtcctcgacgagcgcaccactgcctacgacttcaagggcatttacatcgctgacctgccaaacgtggtcaacatcgatgccatccgcgaagctggtgttcgaatcggcgcagacccaatgggtggcgcatccgtggattactggggtgccatcgcagaaacccatggcctcaacctcaccgtggtcaacccacacgttgattccaccttccgcttcatgacattggacaccgacggcaagatccgcatggactgctccagcccacacgcaatggcatcgctgattgacaaccgagacaagttcgatgtggcaaccggcaacgacgccgacgccgaccgccacggcatcgtcaccccagacgctggcttgatgaaccccaaccactacctcgcagtagcaattgagtacctctttgctcaccgcccaggttggtccgcagataccgcagtgggcaaaaccctggtcagctcctccatgatcgaccgcgttgtggcgcagcttggccgcaccctcgttgaggttccagtcggattcaagtggtttgtcccaggtttgatctccggcgaaatcggattcggtggtgaagaatccgcaggtgcatccttcctccgcatggacggcaccacctggtccaccgacaaggacggcctcatccttgacctcctggcagctgagatcattgcagtaaccggcaagaccccatcacagcgctacgcagaactcgccgaagaattcggtgcacctgcctacgcccgcaccgatgcagaagccaaccgagaacaaaaggccatcctgaaggcactgtccccagaacaggtcaccgccaccgaactagccggcgaagcaatcaccgctaagctcaccgaagctcccggcaatggcgcagccatcggaggactaaaagtgaccaccgaaaacgcctggttcgcagcacgcccatccggcaccgaagacaagtacaagatctacgcagaatccttcaagggcgaagagcacctcgcccaggttcagaaggaagcccaagcgttggtcagcgaagtactcggacagtaaaactgcggacttgctgacaagtttcac

SEQ ID NO: 56 - protein, 554 aa, Corynebacterium glutamicum
MAHERAGQLAQPEDLIDVAELVTAYFTRKPDVNNPDQQVAFGTSGHRGSALDSAFNEDHILATTQAIVDYRNQQPKNWVGPLFIGRDTHALSEPAMISALEVLIANDVEVLVDADGRYTPTPAVSHAILRHNDGIILGTAGPSRPYADGIVITPSHNPPRDGGFKYNPANGGPADTDATDWIANRANDILRGDLADVKRVPVSGVLDERTTAYDFKGIYIADLPNVVNIDAIREAGVRIGADPMGGASVDYWGAIAETHGLNLTVVNPHVDSTFRFMTLDTDGKIRMDCSSPHAMASLIDNRDKFDVATGNDADADRHGIVTPDAGLMNPNHYLAVAIEYLFAHRPGWSADTAVGKTLVSSSMIDRVVAQLGRTLVEVPVGFKWFVPGLISGEIGFGGEESAGASFLRMDGTTWSTDKDGLILDLLAAEIIAVTGKTPSQRYAELAEEFGAPAYARTDAEANREQKAILKALSPEQVTATELAGEAITAKLTEAPGNGAAIGGLKVTTENAWFAARPSGTEDKYKIYAESFKGEEHLAQVQKEAQALVSEVLGQ

SEQ ID NO: 57 - DNA, 1120 bp, Corynebacterium glutamicum
  CDS (101)..(1090): RXA01882
accctttttccaccttggctgattttgatgcccttgttaccgatgaccacacgctagattttccagttttgcccgaccacaactttcaggtggtaaccccatgatcatcacattcaccccaaacccgagtattgattccacgctgtcgctcggcgaagagctctcccgtggatccgtccaacgacttgattccgtcaccgctgtcgcaggtggtaaaggcatcaatgtcgcccacgctgtcttgcttgcgggctttgaaaccttggctgtgttcccagccggcaagctcgaccccttcgtcccactggtccgcgacatcggcttgcccgtggaaactgttgtgatcaacaagaacgtccgcaccaacaccacagtcaccgaaccggacggcaccaccaccaagctcaacggccccggcgcgccgctcagcgagcagaagctccgtagcttggaaaaggtgcttatcgacgcgctccgccccgaagtcacctgggttgtcctggcgggctcgctgccaccaggggcaccagttgactggtacgcgcgtctcaccgcgttgatccattcagcacgccctgacgttcgcgtggctgtcgatacctcagacaagccactgatggcgttgggcgagagcttggatacacctggcgctgctccgaacctgattaagccaaatggtctggaactgggccagctggctaacactgatggtgaagagctggaggcgcgtgctgcgcaaggcgattacgacgccatcatcgcagctgcggacgtactggttaaccgtggcatcgaacaggtgcttgtcaccttgggtgccgcaggagcggtgttggtcaacgcagaaggtgcgtggactgctacttctccaaagattgatgttgtatccaccgttggagctggagactgtgctcttgcaggttttgttatggcacgttcccagaagaaaacactggaggaatctctgctgaatgccgtgtcttacggctcgactgcggcgtctcttcctggcactaccattcctcgtcctgaccaactcgccacagctggtgcaacggtcacccaagtcaaaggattgaaagaatcagcatgaatagcgtaaataattcctcgcttgtcc

SEQ ID NO: 58 - protein, 330 aa, Corynebacterium glutamicum
MIITFTPNPSIDSTLSLGEELSRGSVQRLDSVTAVAGGKGINVAHAVLLAGFETLAVFPAGKLDPFVPLVRDIGLPVETVVINKNVRTNTTVTEPDGTTTKLNGPGAPLSEQKLRSLEKVLIDALRPEVTWVVLAGSLPPGAPVDWYARLTALIHSARPDVRVAVDTSDKPLMALGESLDTPGAAPNLIKPNGLELGQLANTDGEELEARAAQGDYDAIIAAADVLVNRGIEQVLVTLGAAGAVLVNAEGAWTATSPKIDVVSTVGAGDCALAGFVMARSQKKTLEESLLNAVSYGSTAASLPGTTIPRPDQLATAGATVTQVKGLKESA

SEQ ID NO: 59 - DNA, 1141 bp, Corynebacterium glutamicum
  CDS (101)..(1111): RXA01887
catctttacaggaaaccccttgacggcatcaatgggtggtatctagtatctactagaacgttatagtagaacgttctagtaaaacttggaaggatgaaaaatgtcagtcaaacttgccctcatcggtgctggacgcatcggatcaaatcacgcacgcctgatcacaaaccacgtgatcggctctgaactggtcgccgtcgttgacccaactcccaacgcagaaaccctcgctgatgaattgggcgccgttgcgttctctaacccagatgacgtcctgacccgcgatgacattgacgcggttttgattgctacaccagcacgaacccacgcggatctcgtggtcaaagcagcggcagcgggcaagcacgtgtttgtggaaaagcccatggccgtcaccctcgaggacgcagatcgtgccatcaacgcagcacgcgaagcaaacactgtcctgcaggtgggcttcaatcgtcgtttcgcggcaggtttcgctgcagcacgcgcacgcattgacgcaggcgatatcggcaccccacagctgcttcgttccgtgacccgcgatccaggaccattcaccgctgaccccaacaagatccctcagtggaccatcttcctggaaaccctcatccacgatttcgatgcgctgtgctacctcaacccaggcgcaaccccagtggaagtaaccgctcacgctgattgcctcgtcgttccagaagctgctggcactggcttcctcgacaccgcagtggtgactgtccgttttgataacggagcaattggtactgcagaagcaagcttcagcgcagcctatggttatgacgttcgcggtgaagtcttcggatccaagggcatgatgaccgcaggcgacgcgcgcgcaaccaacatgactttctacggcgctgagggcatcgcggctgccaccttacgcgcggataccgatctgctctccgatgcttaccgagctgaattccaagctttcgtcgactccatccgtaccaacaccccttccaaggttccaggcgaagctgcacgcaccgcactactcatcgcactcggcgccatccgaagcgtagaaaccggcgcaaccatcaaccttgctgaaagcatcgaggtttaaccatgacttttaaactcgcagcatgcg

SEQ ID NO: 60 - protein, 337 aa, Corynebacterium glutamicum
MSVKLALIGAGRIGSNHARLITNHVIGSELVAVVDPTPNAETLADELGAVAFSNPDDVLTRDDIDAVLIATPARTHADLVVKAAAAGKHVFVEKPMAVTLEDADRAINAAREANTVLQVGFNRRFAAGFAAARARIDAGDIGTPQLLRSVTRDPGPFTADPNKIPQWTIFLETLIHDFDALCYLNPGATPVEVTAHADCLVVPEAAGTGFLDTAVVTVRFDNGAIGTAEASFSAAYGYDVRGEVFGSKGMMTAGDARATNMTFYGAEGIAAATLRADTDLLSDAYRAEFQAFVDSIRTNTPSKVPGEAARTALLIALGAIRSVETGATINLAESIEV

SEQ ID NO: 61 - DNA, 3853 bp, Corynebacterium glutamicum
  CDS (101)..(3823): RXA02056
gtggcatttaatggcctgacacgttatttttaggagaactgtcaacaaattaatgctacaactggggcttaggcataatcagccaacgaccaacgttacagtggataaaacaaagctcaataaaccctcaagaagcaaggaaaagaggcgagtacctgccgtgagcagcgctagtactttcggccagaatgcgtggctggtagacgagatgttccagcagttccagaaggaccccaagtccgtggacaaggaatggagagaactctttgaggcgcaggggggaccaaatactacccccgctacaacagaagcacagccttcagcgcccaaggagtctgcgaaaccagcaccaaaggctgcccctgcagccaaggcagcaccgcgcgtagaaaccaagccggccgacaagaccgcccctaaggccaaggagtcctcagtgccacagcaacctaagcttccggagccaggacaaaccccaatcaggggtattttcaagtccatcgcgaagaacatggatatctccctggaaatcccaaccgcaacctcggttcgcgatatgccagctcgcctcatgttcgaaaaccgcgcgatggtcaacgatcagctcaagcgcacccgcggtggcaagatctccttcacccacatcattggctacgccatggtgaaggcagtcatggctcacccggacatgaacaactcctacgacgtcatcgacggcaagccaaccctgatcgtgcctgagcacatcaacctgggccttgctatcgaccttcctcagaaggacggctcccgcgcacttgtcgtagcagccatcaaggaaaccgagaagatgaacttctccgagttcctcgcagcctacgaagacatcgtggcacgctcccgcaagggcaagctcaccatggatgactaccagggcgttaccgtttccttgaccaacccaggtggcatcggtacccgccactctgttccacgtctaaccaagggccagggcaccatcatcggtgtcggttccatggattacccagcagagttccagggcgcttcagaagaccgccttgcagagctcggcgttggcaaacttgtcaccatcacctccacctacgatcaccgcgtgatccagggtgctgtgtccggtgaattcctgcgcaccatgtctcgcctgctcaccgatgattccttctgggatgagatcttcgacgcaatgaacgttccttacaccccaatgcgttgggcacaggacgttccaaacaccggtgttgataagaacacccgcgtcatgcagctcattgaggcataccgctcccgtggacacctcatcgctgacaccaacccactttcatgggttcagcctggcatgccagttccagaccaccgcgacctcgacatcgagacccacaacctgaccatctgggatctggaccgtaccttcaacgtcggtggcttcggcggcaaggagaccatgaccctgcgcgaggtactgtcccgcctccgcgctgcgtacaccctcaaggtcggctccgaatacacccacatcctggaccgcgacgagcgcacctggctgcaggaccgcctcgaggccggaatgccaaagccaacccaggcagagcagaagtacatcctgcagaagctgaacgccgcggaggctttcgagaacttcctgcagaccaagtacgtcggccagaagcgcttctccctcgaaggtgcagaagcacttatcccactgatggactccgccatcgacaccgccgcaggccaaggcctcgacgaagttgtcatcggtatgccacaccgtggtcgcctcaacgtgctgttcaacatcgtgggcaagccactggcatccatcttcaacgagtttgaaggccaaatggagcagggccagatcggtggctccggtgacgtgaagtaccacctcggttccgaaggccagcacctgcagatgttcggcgacggcgagatcaaggtctccctgactgctaacccgtcccacctggaagctgttaacccagtgatggaaggtatcgtccgcgcaaagcaggactacctggacaagggcgtagacggcaagactgttgtgccactgctgctccacggtgacgctgcattcgcaggcctgggcatcgtgccagaaaccatcaacctggctaagctgcgtggctacgacgtcggcggcaccatccacatcgtggtgaacaaccagatcggcttcaccaccaccccagactccagccgctccatgcactacgcaaccgactacgccaaggcattcggctgcccagtcttccacgtcaacggcgacgacccagaggcagttgtctgggttggccagctggccaccgagtaccgtcgtcgcttcggcaaggacgtcttcatcgacctcgtctgctaccgcctccgcggccacaacgaagctgatgatccttccatgacccagccaaagatgtatgagctcatcaccggccgcgagaccgttcgtgctcagtacaccgaagacctgctcggacgtggagacctctccaacgaagatgcagaagcagtcgtccgcgacttccacgaccagatggaatctgtgttcaacgaagtcaaggaaggcggcaagaagcaggctgaggcacagaccggcatcaccggctcccagaagcttccacacggccttgagaccaacatctcccgtgaagagctcctggaactgggacaggctttcgccaacaccccagaaggcttcaactaccacccacgtgtggctcccgttgctaagaagcgcgtctcctctgtcaccgaaggtggcatcgactgggcatggggcgagctcctcgccttcggttccctggctaactccggccgcttggttcgccttgcaggtgaagattcccgccgcggtaccttcacccagcgccacgcagttgccatcgacccagcgaccgctgaagagttcaacccactccacgagcttgcacagtccaagggcaacaacggtaagttcctggtctacaactccgcactgaccgagtacgcaggcatgggcttcgagtacggctactccgtaggaaacgaagactccatcgttgcatgggaagcacagttcggcgacttcgccaacggcgctcagaccatcatcgatgagtacgtctcctcaggcgaagctaagtggggccagacctccaagctgatccttctgctgcctcacggctacgaaggccagggcccagaccactcttccgcacgtatcgagcgcttcctgcagctgtgcgctgagggttccatgactgttgctcagccatccaccccagcaaaccacttccacctactgcgtcgtcacgctctgtccgacctgaagcgtccactggttatcttcaccccgaagtccatgctgcgtaacaaggctgctgcctccgcaccagaagacttcactgaggtcaccaagttccagtccgtgatcaacgatccaaacgttgcagatgcagccaaggtgaagaaggtcatgctggtctccggcaagctgtactacgaattggcaaagcgcaaggagaaggacggacgcgacgacatcgcgatcgttcgtatcgaaatgctccacccaattccgttcaaccgcatctccgaggctcttgccggctaccctaacgctgaggaagtcctcttcgttcaggatgagccagcaaaccagggcccatggccgttctaccaggagcacctcccagagctgatcccgaacatgccaaagatgcgccgcgtttcccgccgcgctcagtcctccaccgcaactggtgttgccaaggtgcaccagctggaggagaagcagcttatcgacgaggctttcgaggcttaagtctttatagtcctgcactagcctaga

SEQ ID NO: 62 - protein, 1241 aa, Corynebacterium glutamicum
VDKTKLNKPSRSKEKRRVPAVSSASTFGQNAWLVDEMFQQFQKDPKSVDKEWRELFEAQGGPNTTPATTEAQPSAPKESAKPAPKAAPAAKAAPRVETKPADKTAPKAKESSVPQQPKLPEPGQTPIRGIFKSIAKNMDISLEIPTATSVRDMPARLMFENRAMVNDQLKRTRGGKISFTHIIGYAMVKAVMAHPDMNNSYDVIDGKPTLIVPEHINLGLAIDLPQKDGSRALVVAAIKETEKMNFSEFLAAYEDIVARSRKGKLTMDDYQGVTVSLTNPGGIGTRHSVPRLTKGQGTIIGVGSMDYPAEFQGASEDRLAELGVGKLVTITSTYDHRVIQGAVSGEFLRTMSRLLTDDSFWDEIFDAMNVPYTPMRWAQDVPNTGVDKNTRVMQLIEAYRSRGHLIADTNPLSWVQPGMPVPDHRDLDIETHNLTIWDLDRTFNVGGFGGKETMTLREVLSRLRAAYTLKVGSEYTHILDRDERTWLQDRLEAGMPKPTQAEQKYILQKLNAAEAFENFLQTKYVGQKRFSLEGAEALIPLMDSAIDTAAGQGLDEVVIGMPHRGRLNVLFNIVGKPLASIFNEFEGQMEQGQIGGSGDVKYHLGSEGQHLQMFGDGEIKVSLTANPSHLEAVNPVMEGIVRAKQDYLDKGVDGKTVVPLLLHGDAAFAGLGIVPETINLAKLRGYDVGGTIHIVVNNQIGFTTTPDSSRSMHYATDYAKAFGCPVFHVNGDDPEAVVWVGQLATEYRRRFGKDVFIDLVCYRLRGHNEADDPSMTQPKMYELITGRETVRAQYTEDLLGRGDLSNEDAEAVVRDFHDQMESVFNEVKEGGKKQAEAQTGITGSQKLPHGLETNISREELLELGQAFANTPEGFNYHPRVAPVAKKRVSSVTEGGIDWAWGELLAFGSLANSGRLVRLAGEDSRRGTFTQRHAVAIDPATAEEFNPLHELAQSKGNNGKFLVYNSALTEYAGMGFEYGYSVGNEDSIVAWEAQFGDFANGAQTIIDEYVSSGEAKWGQTSKLILLLPHGYEGQGPDHSSARIERFLQLCAEGSMTVAQPSTPANHFHLLRRHALSDLKRPLVIFTPKSMLRNKAAASAPEDFTEVTKFQSVINDPNVADAAKVKKVMLVSGKLYYELAKRKEKDGRDDIAIVRIEMLHPIPFNRISEALAGYPNAEEVLFVQDEPANQGPWPFYQEHLPELIPNMPKMRRVSRRAQSSTATGVAKVHQLEEKQLIDEAFEA

SEQ ID NO: 63 - DNA, 1381 bp, Corynebacterium glutamicum
  CDS (101)..(1351): RXA02063
atctaaaaacagttgcgcagcgataccgaaatgggggcattaaaaggggctatcattcggaccccaaaacgatgtttagacaatttgttacccagctttcatgcgggatagttattttgcctttatggttaagggtgtgaagggtagaccaaatgttctagcaatcgttctcgcaggtggcgagggcaaacgactttttccgttgacggaggaccgagctaagcctgcggtcccattcggcggaacttacagattgatcgactttgttttgtcgaacctggtgaactccggattcctcaagatcgcggtactgactcagtacaagtcgcattcattggataggcatatttcattgtcgtggaacgtgtctggtccaacggggcagtacattgcttctgttcctgcgcagcagcgcctgggcaagcgatggttcactggttccgcggatgcaattttgcagtctctgaacttgatctctgatgagaaaccggattatgtcatcgttttcggcgcggaccacgtgtatcgcatggacccaagccagatgctagatgagcacattgcatctggtcgcgcggtgtctgtggcaggtattcgcgttccacgtgaggaagcaactgcgtttggttgcatccagtccgatgtcgacggcaacataaccgagttcttggaaaagccagctgaccctccgggaacccctgatgatcctgacatgacttacgcgtcgatgggtaactacattttcaccactgaagccctgatccaggcgctgaaagatgatgaaaataacgagaacagtgatcatgacatgggcggagacatcattccgtacttcgtctctcgcaatgatgcgcatgtttatgatttctccggaaacattgttcctggcgcaactgagcgtgacaagggctactggcgcgacgtcggtaccattgatgcgttctacgagtgccacatggacctgatttccgtgcacccaatcttcaatctgtataactctgagtggccaatccacacgacctctgaaggtaacttgcctccggctaagttcgttcggggcggtatcgcgcagtcgtcgatggtgtcttcaggttccatcatttctgctgggactgttcgcaactccgtgctgtccaacaacgttgtcgtcgaagagggcgcaacggtggaaggtgcagtgctgatgccaggcgtgcgcatcggtaagggtgctgttgtccgccatgcgattctggacaagaacgtggttgtccgcgacggagagctcatcggtgtcgaccaagtgcgcgatgcgcagcgcttcaaggtgagcgccggcggcgtcgtggttgtcggtaagaaccaggtagtctaaacgggaaagggaccttaaaaggtccct

SEQ ID NO: 64 - protein, 417 aa, Corynebacterium glutamicum
MRDSYFAFMVKGVKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 65 - DNA, 2680 bp, Corynebacterium glutamicum
  CDS (101)..(2650): RXA02100
cacatcaccgtttcacttccgggtgtctcaacagatgaacttctgaaccgataactcattctggtagcaggaaccccaatcttaggcttagtttagggctttgaaaccagtaggcacagtacagttcaagaatcagctcccaactcaactccagccactcgtgaagctggcgcataatctgcgctggtcatggcgtgaggaagcaaagcagcttttccgcgacatcgacccagaattgtgggaacagctcgacgaagatcctaagcagatgcttctccaggcaccagcaactcgtttgcagttcctcgcaggcgatgatgagtacctaggtcgagtcaacgccgaggagcaaaacctcagcgaatacctcagcgacaagctgtggtaccaggacaccgcagatgcaaccgatgctgtcggagatccactcgttgcgtacttctccatggagtttggcattcacccaagcctgccaatctactctggcggacttggtgtgcttgcgggcgagaacatgaagtctgcatctgacttgggtgtgccactgatcggtgttggtttgctctacacccacggctacttcacccagtcactgtccggtgacggttggcagcaggaagagtacaagtaccacgatccagcagaactgccgattgaggcagttaaagataagaacggcgagcaggtcactgtttctgtcacctacccaggtgcgcaggaagtaaagattgcactgtgggtagcaaacgttggccgcatcccattgctgctgcttgataccaacatcgaggcaaacccagaagagctccgcaacgttactgaccgcctgtacggtggcgacaatgagcaccgcatcaagcaggaactcgttctcggtgttggtggcgtccgcgctgtcaacgcattctgcgaagctcgtggtctgaagcgctcatctgttgcacacctcaacgaaggccacgcaggtttcctgaccctggagcgtatccgcgagcgcatcgcagagggcatggagtacccagcagcattcgagcaggttcgtgcgtccaacatcttcaccacccacaccccagtcccagcaggcatcgaccgcttcgacatggagatggtgcgtcgttatctcggtggcggtcagccagaagatcagcagctgtgcgttggtgttccaattgagaaggcacttgagcttggtcaagagtccgatccacaccgcttcaacatggctcatatgggccttcgcgcgagccaacatgctaatggcgtcgcaaagcttcatggtgaagtaagccgtgacatgttcgccggcctgtaccccggatatgagcctcgtgaagtgcccatcgggcacgtcaccaacggtgttcacctgccgacgtgggtcaagccagagatgaaggaactcatcgatcgcgtcactggcggcgctgatcttgcggttgctgattcttggtcaaacccacaggctgtcgagtctgagaagatctggaaggtgcgcaacaagttccgtgctgacctagtggaggttgctcgcgctgcaactgcaaagtcctggtctcaccgtggacacaccgaagcagaacttgcgtggacctcccgcgttctggatccaaacgtgctgaccattggtttcgcacgtcgcgtatccacctacaagcgcttgaccttgatgctgcgcaaccctgaacgcctgcgttccatcttgcttaatgaggaacgcccagttcagttcgttattgctggtaaggcacacccacatgacatgggtggcaagaagctcatgcaggaaatcgtccacttcgctgatcaagctggtgtccgtgaccgtttcctcttcctgcctgattacgacatcaacctggccagctacctgatctctggtgctgacgtgtggctgaacaacccagtgcgccctcaggaagcatcgggaacctccggtatgaaggccgtcatgaatggtggcctgaccctgtccatctctgatggttggtgggatgaaatgcctaaggagaccaccggctggaccatcccaaccgttgagtcccaggacttggaatgccgcgaccacctggaatcccaggcgctgtacgacctgctggaaaacgaagttgcaccgctgttttacaagcgcgacaagaacggcatcccacaggactggctggacctggttcgcgaatcctggaccaccctgtcaccaatggtcacctccacccgcatggtgcgcgactacaccacccagtactaccgcccaaccaaacaccaggcagagctcattgcgcagcctgcagaagcagcggattacgcggcatggcttgagcacatcaaagcagagtgggctggcgtcaaggtctcagacctgaagatcagcgagagcgccatcacggcgcaggagcttgaagtcagcgttcgcgttgattccggttcgcttaacgacgacgagttccaagctcaggcactctttggtgcgctcggacacaacggtgacatcgaagatccagaaatcaccgttttgaccccacgcggcgatggcgcctacgcggcaaaggtcagcactgacctgccaggcaactacggcatcactgcccgcgttgttccaaacaacaggatgctggtcagcccagcggaaacccgcctgatcacctacttggagaactagggcgaaactagctttaccaaaaggccg

SEQ ID NO: 66 - protein, 850 aa, Corynebacterium glutamicum
LKPVGTVQFKNQLPTQLQPLVKLAHNLRWSWREEAKQLFRDIDPELWEQLDEDPKQMLLQAPATRLQFLAGDDEYLGRVNAEEQNLSEYLSDKLWYQDTADATDAVGDPLVAYFSMEFGIHPSLPIYSGGLGVLAGENMKSASDLGVPLIGVGLLYTHGYFTQSLSGDGWQQEEYKYHDPAELPIEAVKDKNGEQVTVSVTYPGAQEVKIALWVANVGRIPLLLLDTNIEANPEELRNVTDRLYGGDNEHRIKQELVLGVGGVRAVNAFCEARGLKRSSVAHLNEGHAGFLTLERIRERIAEGMEYPAAFEQVRASNIFTTHTPVPAGIDRFDMEMVRRYLGGGQPEDQQLCVGVPIEKALELGQESDPHRFNMAHMGLRASQHANGVAKLHGEVSRDMFAGLYPGYEPREVPIGHVTNGVHLPTWVKPEMKELIDRVTGGADLAVADSWSNPQAVESEKIWKVRNKFRADLVEVARAATAKSWSHRGHTEAELAWTSRVLDPNVLTIGFARRVSTYKRLTLMLRNPERLRSILLNEERPVQFVIAGKAHPHDMGGKKLMQEIVHFADQAGVRDRFLFLPDYDINLASYLISGADVWLNNPVRPQEASGTSGMKAVMNGGLTLSISDGWWDEMPKETTGWTIPTVESQDLECRDHLESQALYDLLENEVAPLFYKRDKNGIPQDWLDLVRESWTTLSPMVTSTRMVRDYTTQYYRPTKHQAELIAQPAEAADYAAWLEHIKAEWAGVKVSDLKISESAITAQELEVSVRVDSGSLNDDEFQAQALFGALGHNGDIEDPEITVLTPRGDGAYAAKVSTDLPGNYGITARVVPNNRMLVSPAETRLITYLEN

SEQ ID NO: 67 - DNA, 1411 bp, Corynebacterium glutamicum
  CDS (101)..(1381): RXA02144
agaaggacatcatcgccttcatcaagtccaccaaggagactccatcacctggtggttactcactcggtagcttgggcccagtggctgagggtctgttcatgtgggtattcggcatcttggtcctcgtggccgccgctatgtggattggatcacgttcatgagtaacaacaacgacaaacagtacacaacccaagaactcaacgcgatgagcaatgaggatcttgcacgacttggtacagagctggacgacgttaccattgcataccgcaaggaacgtttcccaatcgctaatgacccagctgagaagcgcgctgcacgtgcagttactttctggctagtcctcggcatcattggtggacttgggttcctggctacctacattttctggccttgggagtacaaggcacacggagatgaaggtctcctggcgtacaccttgtacaccccaatgctgggtattacttccggtctttgcatcctgtccctgggatttgcagttgtcctttatgtcaagaagttcattccagaggaaatcgcagtacagcgtcgccacgacggtccttctgaagaagttgaccgccgcaccatcgttgcacttctcaatgactcttggcagacctctactcttggtcgtcgcaagctgatcatgggacttgcaggtggcggagcagtactggccggcctgaccatcatcgctccaatgggcggtatgatcaagaacccttggaatcctaaggaaggcccaatggacgttcagggtgacggcaccctgtggacttccggttggactctcgttgagaacgacgtcaaggtttacctcggccgcgacactgcagcaattgcggagtcccacaccgatgcaaccggtgagcactggtcaaccactggtgtttcccgcctggttcgtatgcgcccagaagatctggcagcagcatccatggaaactgtcttcccacttccagctgaaatggtgaacgacggtgctgaatacgatcctgcgaaggacgtctacgagcaccaaatgcactcggtgcacggcccacgcaacgcagttatgttgatccgtctccgtaccgctgacgctgaaaaggttatcgaacgcgaaggccaggagtccttccactacggtgactactacgcttactccaagatttgtacacacattggttgcccaacctcactgtacgaggctcagaccaatcgtattctgtgcccatgtcaccagtcgcagtttgacgcattgcactacggaaagccagtctttggacctgctgcccgtgcactgccacagctgccaattaccgttgatgaagagggctacctcatcgccgctggtaacttcattgagccactcggccctgcattctgggagcgtaagtcatgagtctagctaccgtgggaaacaatcttg

SEQ ID NO: 68 - protein, 427 aa, Corynebacterium glutamicum
VGIRHLGPRGRRYVDWITFMSNNNDKQYTTQELNAMSNEDLARLGTELDDVTIAYRKERFPIANDPAEKRAARAVTFWLVLGIIGGLGFLATYIFWPWEYKAHGDEGLLAYTLYTPMLGITSGLCILSLGFAVVLYVKKFIPEEIAVQRRHDGPSEEVDRRTIVALLNDSWQTSTLGRRKLIMGLAGGGAVLAGLTIIAPMGGMIKNPWNPKEGPMDVQGDGTLWTSGWTLVENDVKVYLGRDTAAIAESHTDATGEHWSTTGVSRLVRMRPEDLAAASMETVFPLPAEMVNDGAEYDPAKDVYEHQMHSVHGPRNAVMLIRLRTADAEKVIEREGQESFHYGDYYAYSKICTHIGCPTSLYEAQTNRILCPCHQSQFDALHYGKPVFGPAARALPQLPITVDEEGYLIAAGNFIEPLGPAFWERKS

SEQ ID NO: 69 - DNA, 1099 bp, Corynebacterium glutamicum
  CDS (101)..(1069): RXA02149
ttgcagagtgaaccacgatgatggttggacagctgttgatagctaatctttgaaagattaaattcacctaaatcctgtgtagaacgcgaggggcactcttatgccacaaaaaccggccagtttcgcggtgggctttgacatcggcggcaccaacatgcgagccgggcttgtcgacgaatccgggcgcatcgtgaccagtttgtcggcgccgtcgccgcgcacgacgcaggcaatggaacaggggatttttgatctagtcgaacagctcaaggccgaatacccggttggtgctgtgggacttgccgtcgcgggatttttggatcctgagtgcgaggttgttcgatttgccccgcaccttccttggcgcgatgagccagtgcgtgaaaagttggaaaaccttttgggcctgcctgttcgtttggaacatgatgccaactcagcagcgtggggtgagcatcgttttggtgcagctcaaggcgctgacaactgggttttgttggcactcggcactggaattggtgcagcgctgattgaaaaaggcgaaatttaccgtggtgcatatggcacggcaccagaatttggtcatttgcgtgttgttcgtggcggacgcgcatgtgcgtgtggcaaagaaggctgcctggagcgttactgttccggtactgccttggtttacactgcgcgtgaattggcttcgcatggctcattccgcaacagcgggctgtttgacaagatcaaagccgatccgaattccatcaatggaaaaacgatcactgcggcagcgcgccaagaagacccacttgctctcgccgttctggaagatttcagcgagtggctgggcgaaactttggcgatcattgctgatgtccttgacccaggcatgatcatcattggtggcggactgtccaatgctgccgacctttatttggatcgctcggtcaaccactattccacccgcatcgtcggcgcaggatatcgccctttggcacgcgttgccacagctcagttgggtgcggatgctggcatgatcggtgtcgctgatctagctcgacgctctgtagtggaagccaactaggtgtttttcggtgggctgcgatgacgc

SEQ ID NO: 70 - protein, 323 aa, Corynebacterium glutamicum
MPQKPASFAVGFDIGGTNMRAGLVDESGRIVTSLSAPSPRTTQAMEQGIFDLVEQLKAEYPVGAVGLAVAGFLDPECEVVRFAPHLPWRDEPVREKLENLLGLPVRLEHDANSAAWGEHRFGAAQGADNWVLLALGTGIGAALIEKGEIYRGAYGTAPEFGHLRVVRGGRACACGKEGCLERYCSGTALVYTARELASHGSFRNSGLFDKIKADPNSINGKTITAAARQEDPLALAVLEDFSEWLGETLAIIADVLDPGMIIIGGGLSNAADLYLDRSVNHYSTRIVGAGYRPLARVATAQLGADAGMIGVADLARRSVVEAN

SEQ ID NO: 71 - DNA, 883 bp, Corynebacterium glutamicum
  CDS (101)..(853): RXA02196
gcgtggagttgtccgaggaactccagctgcacccagagcagtccacagacgcgtttgtgctctaccacccagaggcaaagtactttaacgtctaacacctttgagagggaaaactttcccgcacattgcagatcgtgccactttaactaaggttgacggcatgattaaggcgattttctgggacatggacggcacgatggtggactctgagccacagtggggcattgctacctacgagctcagcgaagccatgggccgccgcctcaccccggagctccgggaactcaccgtcggctcgagcctgccgcgcaccatgcgcttatgcgcagagcacgcaggcattacattgagcgacgcggactacgagcgctaccgggctggcatgttcgcccgggtccatgagcttttcgacgaatccctcgtcccaaatccaggcgtcaccgaactcctgacagagttgaaggccctcgagatccccatgttggtcaccaccaacacagagcgcgatctcgcgacccgttcagtcgcagccgtgggaaatgagttcttcatcggttctatcgctggtgatgaagtcccaacagcaaagccagcccccgacatgtacctcgaagcagcacgacgtgtgggctttgacccatcagagtgcctcgtgttcgaagattcctacaacggcatgctgggcgctgttactgcaggttgccgcgtcattggtctgcacccagaagaagtccaagcgccagaaggtgtagtgcctttgcgttccctccacggtaaaaactctttcgaaggtgtcaccgctgagatggtcactgcctggtaccaccagatcgagccggcaggtgtcgcaaaataaaaccaggtgggggagtgaaattattcg

SEQ ID NO: 72 - protein, 251 aa, Corynebacterium glutamicum
LRGKTFPHIADRATLTKVDGMIKAIFWDMDGTMVDSEPQWGIATYELSEAMGRRLTPELRELTVGSSLPRTMRLCAEHAGITLSDADYERYRAGMFARVHELFDESLVPNPGVTELLTELKALEIPMLVTTNTERDLATRSVAAVGNEFFIGSIAGDEVPTAKPAPDMYLEAARRVGFDPSECLVFEDSYNGMLGAVTAGCRVIGLHPEEVQAPEGVVPLRSLHGKNSFEGVTAEMVTAWYHQIEPAGVAK

SEQ ID NO: 73 - DNA, 1198 bp, Corynebacterium glutamicum
  CDS (101)..(1168): RXA02206
gccggcatcggcaccccagaacagctcagagatgattcggaggtgtccgctggagctgatcggcaggaactctgtgaggccttgaacgatggagagcacaatggtttgtacccagccaatattttcagttgcggcaggatctgctgctgcggctaggagggttatctcttcattcacccgatctaccgtactaccttatgacctcagtagtgtggtgggcgtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctgtgacttggtccaattacattcactggtaat

SEQ ID NO: 74 - protein, 356 aa, Corynebacterium glutamicum
MVCTQPIFSVAAGSAAAARRVISSFTRSTVLPYDLSSVVGVKQRMVGSSGLRVSRLGLGTSTWGSGTELAEAGDIFKAFINSGGTLIDVSPNYTTGVAEEMLGTMLDAEVSRSAVVISSSAGVNPALPLGRRVDCSRRNLIAQLDVTLRALNTDYLDLWSVGYWDEGTPPHEVADTLDYAVRTGRVRYAGVRGYSGWQLAVTHAASNHAAASARPVVVAQNEYSLLERRAEQELLPATQHLGVGFFAGAPLGQGVLTAKYRSEIPHDSRAASTGRDAEVQSYLDNRGRIIVDALDTAAKGLGISPAVTATTWVRDRPGVTAVIVGARTHEQLSHLLKAESVTLPTPITQALDDVSL

SEQ ID NO: 75 - DNA, 1474 bp, Corynebacterium glutamicum
  CDS (101)..(1444): RXA02399
ttgacgcaccaatgcccgatggagcaatgtgtgaaccacgccaccacgcaaaccgatgcacatcacgtcgaaacagtgacagtgcattagctcatactttgtggtcggcaccgcccattgcgaatcagcacttaaggaagtgactttgatgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggtcgcaggtgacgccaacctctccggccacacctaccctgaccagtccctctacccagcgaactccgttccaagcgtcgttcgtcgcatcaacaacgcactgctgcgttccgatgaaatcgcacgcaccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactcggcgcaatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaactaggacctacaggttctgacaatttaaatc

SEQ ID NO: 76 - protein, 448 aa, Corynebacterium glutamicum
VVGTAHCESALKEVTLMSNVGKPRTAQEIQQDWDTNPRWNGITRDYTADQVADLQGSVIEEHTLARRGSEILWDAVTQEGDGYINALGALTGNQAVQQVRAGLKAVYLSGWQVAGDANLSGHTYPDQSLYPANSVPSVVRRINNALLRSDEIARTEGDTSVDNWVVPIVADGEAGFGGALNVYELQKAMIAAGAAGTHWEDQLASEKKCGHLGGKVLIPTQQHIRTLNSARLAADVANTPTVVIARTDAEAATLITSDVDERDQPFITGERTAEGYYHVKNGLEPCIARAKSYAPYADMIWMETGTPDLELAKKFAEGVRSEFPDQLLSYNCSPSFNWSAHLEADEIAKFQKELGAMGFKFQFITLAGFHSLNYGMFDLAYGYAREGMTSFVDLQNREFKAAEERGFTAVKHQREVGAGYFDQIATTVDPNSSTTALKGSTEEGQFHN

SEQ ID NO: 77 - DNA, 2347 bp, Corynebacterium glutamicum
  CDS (101)..(2317): RXA02404
gttttcacaaccgttaacggcgtagccaaacaagaaggattcgcattcttctggtttaggcacaggtcatctaaaacccatgctttaaaaggagccttcaatgactgaacaggaactgttgtctgctcagactgccgacaacgctggaactgacagcaccgaacgcgttgacgcgggcggaatgcaggttgcaaaagttctctacgactttgtaaccgaagcggtactccctcgcgtgggtgtggatgcggaaaagttctggtccggattcgccgccatcgcccgggacctcaccccacgcaaccgcgagctgcttgctcgccgcgatgaactgcagatgcttatcgacgactaccaccgcaacaactccggcaccatcgaccaagaggcgtacgaggatttcctcaaagaaatcggatacttggttgaggagccagaagctgcagaaatccgtacccaaaacgtcgatacggaaatctccagcaccgcaggacctcagctggttgttccaattctgaacgcacgcttcgcgctgaacgctgccaatgctcgctggggttccctctacgatgcgttgtacggcaccaacgccatcccagaaactgatggcgctgaaaagggcaaggagtacaacccggtccgcggccagaaggtcatcgagtggggtcgtgaattcctcgacagcgttgtcccactggacggtgcttcgcatgccgatgttgagaagtacaacatcaccgatggaaagcttgcagcccacattggagatagcgtctaccgactgaaaaaccgtgaatcctaccgtggcttcaccggcaacttccttgatccagaagcaatcctgctggaaaccaacggcctgcacatcgagctgcagatcgatcctgtccacccaatcggcaaggcagacaagactggtctcaaagacatcgttttggaatctgcgatcaccacgatcatggacttcgaagactccgttgcagctgttgatgctgaagacaagaccttaggttactctaactggttcggactcaacaccggcgaactgaaagaagagatgtccaagaacggacgcatcttcacccgtgagctcaacaaggaccgcgtctacattggccgcaatggtaccgagctggttctgcacggtcgttccctgctgttcgtccgcaacgttggtcacctcatgcaaaacccatccatcttgattgatggcgaggagatcttcgaaggcatcatggatgctgtcttgaccactgtttgtgccatcccaggaattgctccgcagaacaagatgcgcaattcccgcaagggctccatctacatcgtgaagcctaagcagcacggccctgaagaagtcgcgttcaccaacgagctcttcggccgcgttgaggatctgcttgatctgccacgccacaccttgaaggttggtgttatggatgaggagcgtcgcacgtccgtgaacctggatgccagcatcatggaagttgctgaccgcttggcattcatcaacactggcttcctggaccgcaccggcgatgaaatccacacctccatggaagcaggcgccatggtgcgcaaggctgatatgcagaccgcaccgtggaagcaggcctacgagaacaacaacgttgatgcaggtattcagcgtggtcttcctggcaaggctcagatcggtaagggcatgtgggcgatgactgaactcatggcagaaatgctggagaagaagatcggccagccacgcgaaggcgccaacactgcatgggttccttcaccaactggtgcgacgctgcacgcaacgcactaccacttggttgatgtgttcaaggttcaagacgaactgcgtgctgccggccgccgcgacagcctgcgcaacattctcaccattccaaccgcaccaaacaccaattggtctgaggaagagaagaaggaagagatggacaacaactgccagtccatcctcggatacgttgtgcgctgggttgagcacggtgttggttgctccaaggttccagacatccatgacatcgacctcatggaagaccgcgcaacgctgcgtatttcctcgcagatgctggccaactggatccgccatgatgttgtctcgaaggagcaggtcttggagtcactggaacgaatggcagtggtcgtcgacaagcaaaatgcgggcgacgaggcctaccgcgatatggcgccgaactacgacgcctccctcgccttccaggcggctaaggacttgattttcgaaggcaccaagtccccatcgggctacaccgagcccatcttgcacgcacgccgccgcgagttcaaagcaaaaaactaagcacgcttttcgacgcttacctgcatc

SEQ ID NO: 78 - protein, 739 aa, Corynebacterium glutamicum
MTEQELLSAQTADNAGTDSTERVDAGGMQVAKVLYDFVTEAVLPRVGVDAEKFWSGFAAIARDLTPRNRELLARRDELQMLIDDYHRNNSGTIDQEAYEDFLKEIGYLVEEPEAAEIRTQNVDTEISSTAGPQLVVPILNARFALNAANARWGSLYDALYGTNAIPETDGAEKGKEYNPVRGQKVIEWGREFLDSVVPLDGASHADVEKYNITDGKLAAHIGDSVYRLKNRESYRGFTGNFLDPEAILLETNGLHIELQIDPVHPIGKADKTGLKDIVLESAITTIMDFEDSVAAVDAEDKTLGYSNWFGLNTGELKEEMSKNGRIFTRELNKDRVYIGRNGTELVLHGRSLLFVRNVGHLMQNPSILIDGEEIFEGIMDAVLTTVCAIPGIAPQNKMRNSRKGSIYIVKPKQHGPEEVAFTNELFGRVEDLLDLPRHTLKVGVMDEERRTSVNLDASIMEVADRLAFINTGFLDRTGDEIHTSMEAGAMVRKADMQTAPWKQAYENNNVDAGIQRGLPGKAQIGKGMWAMTELMAEMLEKKIGQPREGANTAWVPSPTGATLHATHYHLVDVFKVQDELRAAGRRDSLRNILTIPTAPNTNWSEEEKKEEMDNNCQSILGYVVRWVEHGVGCSKVPDIHDIDLMEDRATLRISSQMLANWIRHDVVSKEQVLESLERMAVVVDKQNAGDEAYRDMAPNYDASLAFQAAKDLIFEGTKSPSGYTEPILHARRREFKAKN

SEQ ID NO: 79 - DNA, 877 bp, Corynebacterium glutamicum
  CDS (101)..(847): RXA02414
tgtcggctcatgctgcagattgcgtacaggacgctatcatcgacgccatacttaccgcgagtccgggactcgggctcaaaagcttcagggaacttttaccatgagttacaacagcccgtataacaacacgaatttcagcaccactggcgcgttccaacctgctggtgggccggtgaagccgtggaataagcccgatgccagcctgaatcagcagctgaaaaacaaatcccgtgtgcgcacaggtcttaccatcgccatcggttatgtagtggtgatttgggcggtgcatttggcatccatcgtcattgcgctgctcactggcttcaacctgaccaactttggtattcatccgctggataccagtgcactgtggggtattttcacctcaccgctgttgcatggaagcttcagccacctcattggaaataccgttccaggctttatattcagtttcctcatcggtatgagtggcaagcgcgtgttctgggaagtcacgattatcgcaggtctcatcggcggtcttggtacatggattttcggtggaatcggcaccaaccacatcggtgcgtccggcctgatttatggctggcttggctacctgatcgtgcgtggaattttcaacaaggatattaaacagttcctgcttggcatagttttggcgttcatttactccggtttgttctggggtctgctacctactcaaatcggtgtgtcctggcagggccaccttttcggtgcacttggtggaatcggtgcgggtgcttttatcgcctcggatgacccggcagcgttgaaagcgaagaagcaacagaagaaattagaaaagcaacaacgccaaagaggcttatagttttcacctagcgactacacttaattg

SEQ ID NO: 80 - protein, 249 aa, Corynebacterium glutamicum
MSYNSPYNNTNFSTTGAFQPAGGPVKPWNKPDASLNQQLKNKSRVRTGLTIAIGYVVVIWAVHLASIVIALLTGFNLTNFGIHPLDTSALWGIFTSPLLHGSFSHLIGNTVPGFIFSFLIGMSGKRVFWEVTIIAGLIGGLGTWIFGGIGTNHIGASGLIYGWLGYLIVRGIFNKDIKQFLLGIVLAFIYSGLFWGLLPTQIGVSWQGHLFGALGGIGAGAFIASDDPAALKAKKQQKKLEKQQRQRGL

SEQ ID NO: 81 - DNA, 1780 bp, Corynebacterium glutamicum
  CDS (101)..(1750): RXA02434
cttcaatagtcaaaaccagcaaactaattttttaagttttacgtaactggccccaccgcttgtggcaggccttgcgttttgacattgaaggaccctttttatgcgcacttttgccgcttatattgccattgatggcctcagcttttcctaccccaacacccacgttttaagcgatatttcgctcaccgttgccaatggcgatatcgccggactgattggtgaaaacggcgcaggaaaatccaccctgctcagcctcatcgctggcgtcatggaacccgaccagggcaggatttacctccccgaacgcaccggattcatcgcccaagaaacagacttaccgtttgaacaacccgtgcagtcgcttatcgacgccgccgtcgccccagtgcgcgcggtcgatgccgcgattacagatttgtccaccaagcttggcgacgcctccctcagcgccgaagagcaggcgcaagtcgccacagatttcgatgcagcgctaggcgctgcagaagaactcggactgtgggaattagatgcacgtattgaaaccatcgtcgcgggtctcggccttgccgaggtggatcgcagcactcccattggtgagctttccggcggtcagcgccgcagattcgcattggcagcgctgctgttggaaccacacgatgctctgattttcgatgagcccaccaaccacctcgacgacacagccgtagatttcctcatctcggagatttcccgtttcaaaggtccagtgctgatcgccagccacgatcgcttcttcctcgactccgtctgtaccgagttaatcgacctcgatcctgcacttggacctgagggcggatccggcgaagaagtaaaacaagccgtgtcttttggtggtggattttctgaatacatcaaagaacgcgagacccgccgcacccgctgggctcagttgtacaccgcacaagaaaccgagcgggaaaaactcgaagaaaccaccggcaccaccgaatcggatattttccacagctcggtttccaaatcggaagctaaaatcaccgcgaaattttacgcagaccgggcagctaaaactcaaggcaaccgcgtccgctccgccaaaaaccgcctgaaggaattggaacgctatgaaatcccagcacctccaaagccactggaattccaaggcatcccagaagcctccggaaacggtcacggtgaaacactagaagtgcgggctattgctgtggaaaacaggcttcaacccttgactttccacatcgatcccggcgaccacatcctggtcgaaggccccaacggtgtcggtaaatccaccctgctgagcgttctggaaggcgtgcttgaaccaaccgaaggtgaattgatcgtccccgaagggctgaaagttgcgcgcctgaaacaggacgatcagtggacggaaaagcagttgaacacccccgtcgacgaactgttcgccgccctatcgaaaggtccggtcggactcaacctcgtggagatggggctgttgagggagacgtcgcaaagcagcccgctacgggccctatcgctcggccaacgccggcgcgtctcgctcgggctcatcctggcgagcccaccagatcttttgcttcttgacgagcccaccaaccacctctccctcgcgctgagcgaagaactcgagtcggcgatagaaaaattccccggtcgcgttattctggccagccacgataggtggatcagaaaacgttggacggggaagaaaatcagcctgagccgttaaaccctactgaacaggaacctcttcaac

SEQ ID NO: 82 - protein, 550 aa, Corynebacterium glutamicum
MRTFAAYIAIDGLSFSYPNTHVLSDISLTVANGDIAGLIGENGAGKSTLLSLIAGVMEPDQGRIYLPERTGFIAQETDLPFEQPVQSLIDAAVAPVRAVDAAITDLSTKLGDASLSAEEQAQVATDFDAALGAAEELGLWELDARIETIVAGLGLAEVDRSTPIGELSGGQRRRFALAALLLEPHDALIFDEPTNHLDDTAVDFLISEISRFKGPVLIASHDRFFLDSVCTELIDLDPALGPEGGSGEEVKQAVSFGGGFSEYIKERETRRTRWAQLYTAQETEREKLEETTGTTESDIFHSSVSKSEAKITAKFYADRAAKTQGNRVRSAKNRLKELERYEIPAPPKPLEFQGIPEASGNGHGETLEVRAIAVENRLQPLTFHIDPGDHILVEGPNGVGKSTLLSVLEGVLEPTEGELIVPEGLKVARLKQDDQWTEKQLNTPVDELFAALSKGPVGLNLVEMGLLRETSQSSPLRALSLGQRRRVSLGLILASPPDLLLLDEPTNHLSLALSEELESAIEKFPGRVILASHDRWIRKRWTGKKISLSR

SEQ ID NO: 83 - DNA, 1111 bp, Corynebacterium glutamicum
  CDS (101)..(1081): RXA02440
ggaaaaaggaatcataaagccacagcgcaaagccactgaatcaataaagaagcgttaataaagtttgacttgtgcctctgacctgcgttgacttgagtaaatgaagctaccaagactcgccgcagcgctcattggtgctgcgctgttaatcacgggttgttcagctaccgggggagcaccacgggcaacagatggggcatcaggcggaggaaccgtcgatacgcctcggttggttgtcgcgatggtgagccacggcgcgccgggcgatactttttgggatttggtccgaaaaggtgctgaagacgccgcccaaaaagacaacgttgaactccgctattcctctaatccggaaatccctgaacaatccaacctcgtgcaaaatgccatcgattcacgcgtcgacggcatcgccatgaccatgcctaatgctcaatcactaggaccggtcgctcaaaaggccgtggatgcgggcattcctgtggttggtctcaacgctggaatgaacgaataccaagattatggaatgacaggattctttggtcaagatgaatccgtcgcaggagcatccgcaggagcgcgccttgccgaggaaaacgcacaaaaagttttgtgtgtgatccatgaacagggcaactcctcccaggaagctcgctgtggtggcgtgtctgaaggtttgggcaaacaagtagaaaccctgtatgtcaacggcatggatctcacctcagtgaactccaccctgcaggcaaaacttgctcaagaccgcagcattgattgggttgtgggactccaggctggtgtatcaatggctatttctgatgcggcagacgctgcgaactcagaagtaaagatcgccacctttgatacaaacgcacagctcatgaccgctattcgtgatggcaagatccaattcgccattgatcagcaaccatatctgcagggctacatggccgtggattcgctgtggttggcgcaccgaaacggcaccactgttggtggcggacgacccgtgtacacaggaccagccattgtggatgccaccaacgttgatgtcattgctgaagccgttggggagggtctgcgatgacaaaaatcaagagtggggaggcgtcga

SEQ ID NO: 84 - protein, 327 aa, Corynebacterium glutamicum
MKLPRLAAALIGAALLITGCSATGGAPRATDGASGGGTVDTPRLVVAMVSHGAPGDTFWDLVRKGAEDAAQKDNVELRYSSNPEIPEQSNLVQNAIDSRVDGIAMTMPNAQSLGPVAQKAVDAGIPVVGLNAGMNEYQDYGMTGFFGQDESVAGASAGARLAEENAQKVLCVIHEQGNSSQEARCGGVSEGLGKQVETLYVNGMDLTSVNSTLQAKLAQDRSIDWVVGLQAGVSMAISDAADAANSEVKIATFDTNAQLMTAIRDGKIQFAIDQQPYLQGYMAVDSLWLAHRNGTTVGGGRPVYTGPAIVDATNVDVIAEAVGEGLR

SEQ ID NO: 85 - DNA, 940 bp, Corynebacterium glutamicum
  CDS (101)..(910): RXA02474
ataatcttcatcacatggtgtgtgcagaaatatttttgctggtctattgtggcgaccgagggcctttgaaggttcgacaaactgtataaggccttgaatcttgagaatttattttgaggaagcaagaggaagtgtcatgagcaaagttgcaatggttaccggtggtgcacaaggcatcggtcgtggaatttcagagaagctggcagcagatggtttcgatattgccgtagccgacctgccacaacaggaagaacaagctgcagagaccatcaagttgattgaagctgcaggtcaaaaggctgtattcgttggattagatgtcaccgataaggctaatttcgacagtgcaattgatgaggcagcagagaaacttggcggcttcgatgtgctagtaaacaacgccggcatcgcacaaattaagccacttctggaagtcaccgaagaagacctaaagcagatctactccgtgaacgtttttagcgtattttttggtattcaagcagcatcccgaaagttcgatgagcttggcgtaaaaggcaagatcatcaacgctgcatcaatcgctgctatccaaggtttcccaatcttgagcgcctactccaccaccaaattcgcggttcgtggcctcacccaggctgctgcgcaagaactcgcacccaagggtcacaccgtgaatgcctacgcacctggcatcgtgggcaccggaatgtgggagcaaatcgatgccgagctttccaagatcaacggcaagccaatcggtgagaacttcaaggagtactcctcctcaatcgcattgggccgaccatcagtacctgaggatgtagccggtctggtttcgttcctggcttctgaaaactccaactacatcaccggacaggtcatgcttgtcgacggcggcatgctctacaactaggggttgctttcccgcactcaacgcagt

SEQ ID NO: 86 - protein, 270 aa, Corynebacterium glutamicum
LRIYFEEARGSVMSKVAMVTGGAQGIGRGISEKLAADGFDIAVADLPQQEEQAAETIKLIEAAGQKAVFVGLDVTDKANFDSAIDEAAEKLGGFDVLVNNAGIAQIKPLLEVTEEDLKQIYSVNVFSVFFGIQAASRKFDELGVKGKIINAASIAAIQGFPILSAYSTTKFAVRGLTQAAAQELAPKGHTVNAYAPGIVGTGMWEQIDAELSKINGKPIGENFKEYSSSIALGRPSVPEDVAGLVSFLASENSNYITGQVMLVDGGMLYN

SEQ ID NO: 87 - DNA, 1882 bp, Corynebacterium glutamicum
  CDS (101)..(1852): RXA02480
ttgggttggcatcggatcctgcctgtggcctaagatcaggcagtgttgttaaaggacgatcggtaatccgaatggatcgtcccgtagtcaggaggaacctatgaccgctgtggcgcctagggtcgacgggcacgtcgcccctcagaggcccgagccgacaggccatgcacgcaagggcagcaaagcatggttaatgatgaccaccaccgaccacaagcagctgggcattatgtacatcattatgtccttcagcttcttcttcctcggtggcttgatggccctgcttatccgagcggagcttttcacccctggtctgcagttcctgtctaatgagcagttcaaccagctgttcaccatgcacggaactgtcatgctgctgctgtacggaactccaattgtttggggttttgctaactacgtcctgccacttcagatcggtgcgcctgacgtagctttcccacgtttgaatgctttcggcttctggatcaccaccgtcggtggtgtcgcgatgctgaccggcttcctgaccccgggtggtgctgccgacttcggttggaccatgtactccccactgtctgacgcaattcactccccaggccttggctctgacatgtggattgtcggtgtcggtgcaactggtattggctccgttgcttccgcaattaacatgctcaccaccatcctctgcctccgcgcacctggtatgaccatgttccgtatgcctattttcacctggaatatcttcgttgtttccgttcttgctctgctgatcttcccactgctgctcgctgctgcactgggtgttctgtatgaccgcaagcttggtggacacctgtacgatccagctaacggcggctccctcctgtggcagcacctgttctggttcttcggacaccctgaggtttacgttctggcgctgccgttcttcggcattgtttctgagatcattcctgtgttctcccgtaagccaatgttcggttacgtcggcctgatcttcgcaaccttgtccattggtgcactgtccatggctgtgtgggctcaccacatgttcgttactggcgcagttttgcttccgttcttctccttcatgacgttcctgatttcggttcctaccggcgttaagttcttcaactgggttggaaccatgtggaagggtcacatcacttgggaaaccccaatgatctggtctgttggcttcatggctaccttcctcttcggtggtctgaccggcattatgctggcgtccccaccactggacttccacttggctgactcctacttcctgatcgcgcacttccactacaccctcttcggtaccgtggtgttcgcatcgtgtgcaggcgtttacttctggttcccgaagatgactggccgcatgatggacgagcgtcttggcaagatccacttctggttgaccttcgtcggtttccacggaaccttcctcatccagcactgggtgggcaacatgggtatgccacgtcgttacgctgactacctggattctgatggtttcaccatctacaaccagatctccaccgtgttctccttcctgcttggcctgtctgtcattccattcatctggaacgtcttcaagtcctggcgctacggtgagctcgttaccgttgatgatccttggggttacggcaactccctggagtgggcaacctcctgccctcctcctcgccacaacttcgcatccttgcctcgtatccgctccgagcgccctgcgttcgagctgcactacccgcacatgattgaacgcatgcgcgcagaggcacacactggacatcacgatgatattaatgctccagaattgggtaccgccccagcccttgcatctgactccagccgctaaaagcgtctgatttaagtcggtacctga

SEQ ID NO: 88 - protein, 584 aa, Corynebacterium glutamicum
MTAVAPRVDGHVAPQRPEPTGHARKGSKAWLMMTTTDHKQLGIMYIIMSFSFFFLGGLMALLIRAELFTPGLQFLSNEQFNQLFTMHGTVMLLLYGTPIVWGFANYVLPLQIGAPDVAFPRLNAFGFWITTVGGVAMLTGFLTPGGAADFGWTMYSPLSDAIHSPGLGSDMWIVGVGATGIGSVASAINMLTTILCLRAPGMTMFRMPIFTWNIFVVSVLALLIFPLLLAAALGVLYDRKLGGHLYDPANGGSLLWQHLFWFFGHPEVYVLALPFFGIVSEIIPVFSRKPMFGYVGLIFATLSIGALSMAVWAHHMFVTGAVLLPFFSFMTFLISVPTGVKFFNWVGTMWKGHITWETPMIWSVGFMATFLFGGLTGIMLASPPLDFHLADSYFLIAHFHYTLFGTVVFASCAGVYFWFPKMTGRMMDERLGKIHFWLTFVGFHGTFLIQHWVGNMGMPRRYADYLDSDGFTIYNQISTVFSFLLGLSVIPFIWNVFKSWRYGELVTVDDPWGYGNSLEWATSCPPPRHNFASLPRIRSERPAFELHYPHMIERMRAEAHTGHHDDINAPELGTAPALASDSSR

SEQ ID NO: 89 - DNA, 997 bp, Corynebacterium glutamicum
  CDS (101)..(967): RXA02560
ttggggcaagccagctaacgcatttcttgtggaaaccgcagacattgaggccgcccacgcggaacttctaagagcagtggaatgaaataatccggtgctgatgcagggcaactcgcttaatctggcagacaacagcgagagaaagaagcccatgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgttggggttcctcgacgccggaatcgcagctcaaaacgctgcaattgctgcggagtcacttggattgggaacgctctatttgggttcggtgcgcaacgatgcggaagccgtgcacaaattgcttggccttccacctgagatcgtgcctgtcgtgggcttggaaattgggcatgcggatccgtctgaacctgccggaattaaacctcgcctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtcgaaaagcttttcaaaaaccaacaggcagttccttaggggcgtgtttgagcgcgccgggtttgggctgagataaaagcatgattatggacgcctccctccc

SEQ ID NO: 90 - protein, 289 aa, Corynebacterium glutamicum
MQGNSLNLADNSERKKPMPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAALGFLDAGIAAQNAAIAAESLGLGTLYLGSVRNDAEAVHKLLGLPPEIVPVVGLEIGHADPSEPAGIKPRLPQEAIVHWDTYTEKNLELIDSYDRALDTYYSRYGQHQLWSKQTAHRAASKSFSKTNRQFLRGVFERAGFGLR

SEQ ID NO: 91 - DNA, 1960 bp, Corynebacterium glutamicum
  CDS (101)..(1930): RXA02591
atgtgtccgttgtctcacctaaagttttaactagttctgtatctgaaagctacgctagggggcgagaactctgtcgaatgacacaaaatctggagaagtaatgactactgctgcaatcaggggccttcagggcgaggcgccgaccaagaataaggaactgctgaactggatcgcagacgccgtcgagctcttccagcctgaggctgttgtgttcgttgatggatcccaggctgagtgggatcgcatggcggaggatcttgttgaagccggtaccctcatcaagctcaacgaggaaaagcgtccgaacagctacctagctcgttccaacccatctgacgttgcgcgcgttgagtcccgcaccttcatctgctccgagaaggaagaagatgctggcccaaccaacaactgggctccaccacaggcaatgaaggacgaaatgtccaagcattacgctggttccatgaaggggcgcaccatgtacgtcgtgcctttctgcatgggtccaatcagcgatccggaccctaagcttggtgtgcagctcactgactccgagtacgttgtcatgtccatgcgcatcatgacccgcatgggtattgaagcgctggacaagatcggcgcgaacggcagcttcgtcaggtgcctccactccgttggtgctcctttggagccaggccaggaagacgttgcatggccttgcaacgacaccaagtacatcacccagttcccagagaccaaggaaatttggtcctacggttccggctacggcggaaacgcaatcctggcaaagaagtgctacgcactgcgtatcgcatctgtcatggctcgcgaagaaggatggatggctgagcacatgctcatcctgaagctgatcaacccagagggcaaggcgtaccacatcgcagcagcattcccatctgcttgtggcaagaccaacctcgccatgatcactccaaccatcccaggctggaccgctcaggttgttggcgacgacatcgcttggctgaagctgcgcgaggacggcctctacgcagttaacccagaaaatggtttcttcggtgttgctccaggcaccaactacgcatccaacccaatcgcgatgaagaccatggaaccaggcaacaccctgttcaccaacgtggcactcaccgacgacggcgacatctggtgggaaggcatggacggcgacgccccagctcacctcattgactggatgggcaacgactggaccccagagtccgacgaaaacgctgctcaccctaactcccgttactgcgtagcaatcgaccagtccccagcagcagcacctgagttcaacgactgggaaggcgtcaagatcgacgcaatcctcttcggtggacgtcgcgcagacaccgtcccactggttacccagacctacgactgggagcacggcaccatggttggtgcactgctcgcatccggtcagaccgcagcttccgcagaagcaaaggtcggcacactccgccacgacccaatggcaatgctcccattcattggctacaacgctggtgaatacctgcagaactggattgacatgggtaacaagggtggcgacaagatgccatccatcttcctggtcaactggttccgccgtggcgaagatggacgcttcctgtggcctggcttcggcgacaactctcgcgttctgaagtgggtcatcgaccgcatcgaaggccacgttggcgcagacgagaccgttgttggacacaccgctaaggccgaagacctcgacctcgacggcctcgacaccccaattgaggatgtcaaggaagcactgaccgctcctgcagagcagtgggcaaacgacgttgaagacaacgccgagtacctcactttcctcggaccacgtgttcctgcagaggttcacagccagttcgatgctctgaaggcccgcatttcagcagctcacgcttaaagttcacgcttaagaactgctaaataa

SEQ ID NO: 92 - protein, 610 aa, Corynebacterium glutamicum
MTTAAIRGLQGEAPTKNKELLNWIADAVELFQPEAVVFVDGSQAEWDRMAEDLVEAGTLIKLNEEKRPNSYLARSNPSDVARVESRTFICSEKEEDAGPTNNWAPPQAMKDEMSKHYAGSMKGRTMYVVPFCMGPISDPDPKLGVQLTDSEYVVMSMRIMTRMGIEALDKIGANGSFVRCLHSVGAPLEPGQEDVAWPCNDTKYITQFPETKEIWSYGSGYGGNAILAKKCYALRIASVMAREEGWMAEHMLILKLINPEGKAYHIAAAFPSACGKTNLAMITPTIPGWTAQVVGDDIAWLKLREDGLYAVNPENGFFGVAPGTNYASNPIAMKTMEPGNTLFTNVALTDDGDIWWEGMDGDAPAHLIDWMGNDWTPESDENAAHPNSRYCVAIDQSPAAAPEFNDWEGVKIDAILFGGRRADTVPLVTQTYDWEHGTMVGALLASGQTAASAEAKVGTLRHDPMAMLPFIGYNAGEYLQNWIDMGNKGGDKMPSIFLVNWFRRGEDGRFLWPGFGDNSRVLKWVIDRIEGHVGADETVVGHTAKAEDLDLDGLDTPIEDVKEALTAPAEQWANDVEDNAEYLTFLGPRVPAEVHSQFDALKARISAAHA

SEQ ID NO: 93 - DNA, 1015 bp, Corynebacterium glutamicum
  CDS (101)..(985): RXA02654
tattttcggaaatttatacagcaatcctcgaaatcctaataaagatcccttatcgtgggagaggtacggtagttcgttcgaggacaacgtcgagaaaggcatgatttcattgctaaatgatccacgtacgctattcccgaaagtcgatcccccaaagcaaagccagccggaaccaggcctagatataaaactttccccccaagccgatattggtctctccagctatcaaggaagtggaaggcttaagggccgcaaggctcttattactggtggcgattctgggattggagctgccgtagcaatcgcttatgctcgcgagggggcagatgttgcgatcgcttacttgcccgaagaacaagccgatgctgacagagtgctccaagcaatcgaggaaacaggtcaaaaagctttttctttccctggtgatctccgtgatccagaatactgtcgctcgctggtccaagagacggtgaacgctttaggtggcctagacatcttggtcaacaacgcgtcacgtcaggtgtgggcacctggtttgaccgaaattaccgacgaaaacttcgaccagactttgcaggttaacctctatggtagttttcgggttaccaaagcagctatacctcatctgaagcccggatcatcgataatctttacatcgtccattcaggcgtaccaaccttcggaaaccctcttggattacgccatgactaaggcggcattgaacaatttgtcaaagggcttggcaagtagtctgataggcgatggcattcgggtaaattctgtagccccaggtcctttctggacgccgttgcaacccagccatggtcagccacaagagaaaatagaaggatttggccagcacgctccgattggaagagcgggtcaccctgttgagttggcaggtgcgtacgtttttctcgcttctgacgaagccagctatgtggtaggagaaaccctgggagtcacaggtgggacgcccaccccatagtcggtacaagcggaatcactttctcag

SEQ ID NO: 94 - protein, 295 aa, Corynebacterium glutamicum
MISLLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 95 - DNA, 1084 bp, Corynebacterium glutamicum
  CDS (101)..(1054): RXA02694
taatcgggcataattaaaggtgtaacaaaggaatccgggcacaagctcttgctgattttctgagctgctttgtgggttgtccggttagggaaatcaggaagtgggatcgaaaatgaaagaaaccgtcggtaacaagattgtcctcattggcgcaggagatgttggagttgcatacgcatacgcactgatcaaccagggcatggcagatcaccttgcgatcatcgacatcgatgaaaagaaactcgaaggcaacgtcatggacttaaaccatggtgttgtgtgggccgattcccgcacccgcgtcaccaagggcacctacgctgactgcgaagacgcagccatggttgtcatttgtgccggcgcagcccaaaagccaggcgagacccgcctccagctggtggacaaaaacgtcaagattatgaaatccatcgtcggcgatgtcatggacagcggattcgacggcatcttcctcgtggcgtccaacccagtggatatcctgacctacgcagtgtggaaattctccggcttggaatggaaccgcgtgatcggctccggaactgtcctggactccgctcgattccgctacatgctgggcgaactctacgaagtggcaccaagctccgtccacgcctacatcatcggcgaacacggcgacactgaacttccagtcctgtcctccgcgaccatcgcaggcgtatcgcttagccgaatgctggacaaagacccagagcttgagggccgtctagagaaaattttcgaagacacccgcgacgctgcctatcacattatcgacgccaagggctccacttcctacggcatcggcatgggtcttgctcgcatcacccgcgcaatcctgcagaaccaagacgttgcagtcccagtctctgcactgctccacggtgaatacggtgaggaagacatctacatcggcaccccagctgtggtgaaccgccgaggcatccgccgcgttgtcgaactagaaatcaccgaccacgagatggaacgcttcaagcattccgcaaataccctgcgcgaaattcagaagcagttcttctaaatctttggcgcctagttggcgacgcaa

SEQ ID NO: 96 - protein, 318 aa, Corynebacterium glutamicum
VGSKMKETVGNKIVLIGAGDVGVAYAYALINQGMADHLAIIDIDEKKLEGNVMDLNHGVVWADSRTRVTKGTYADCEDAAMVVICAGAAQKPGETRLQLVDKNVKIMKSIVGDVMDSGFDGIFLVASNPVDILTYAVWKFSGLEWNRVIGSGTVLDSARFRYMLGELYEVAPSSVHAYIIGEHGDTELPVLSSATIAGVSLSRMLDKDPELEGRLEKIFEDTRDAAYHIIDAKGSTSYGIGMGLARITRAILQNQDVAVPVSALLHGEYGEEDIYIGTPAVVNRRGIRRVVELEITDHEMERFKHSANTLREIQKQFF

SEQ ID NO: 97 - DNA, 955 bp, Corynebacterium glutamicum
  CDS (101)..(925): RXA02735
accggctcgatcatcatcaccatctatgacgctcatacccttcaggtagagatgccggaatccggcaatgccccatcgctggtggctattggtcgtcgaagtgagtccgactgcttgtctgaggagcttcgccacatggatccagatttgggctaccagcacgcactatccggcttgtccagcgtcaagctggaaaccgtctaaggagaaatacaacactatggttgatgtagtacgcgcacgcgatactgaagatttggttgcacaggctgcctccaaattcattgaggttgttgaagcagcaactgccaataatggcaccgcacaggtagtgctcaccggtggtggcgccggcatcaagttgctggaaaagctcagcgttgatgcggctgaccttgcctgggatcgcattcatgtgttcttcggcgatgagcgcaatgtccctgtcagtgattctgagtccaatgagggccaggctcgtgaggcactgttgtccaaggtttctatccctgaagccaacattcacggatatggtctcggcgacgtagatcttgcagaggcagcccgcgcttacgaagctgtgttggatgaattcgcaccaaacggctttgatcttcacctgctcggcatgggtggcgaaggccatatcaactccctgttccctcacaccgatgcagtcaaggaatcctccgcaaaggtcatcgcggtgtttgattcccctaagcctccttcagagcgtgcaactctaacccttcctgcggttcactccgcaaagcgcgtgtggttgctggtttctggtgcggagaaggctgaggcagctgcggcgatcgtcaacggtgagcctgctgttgagtggcctgctgctggagctaccggatctgaggaaacggtattgttcttggctgatgatgctgcaggaaatctctaagcagcgccagctctaacaagaagcttt

SEQ ID NO: 98 - protein, 275 aa, Corynebacterium glutamicum
VSPTACLRSFATWIQIWATSTHYPACPASSWKPSKEKYNTMVDVVRARDTEDLVAQAASKFIEVVEAATANNGTAQVVLTGGGAGIKLLEKLSVDAADLAWDRIHVFFGDERNVPVSDSESNEGQAREALLSKVSIPEANIHGYGLGDVDLAEAARAYEAVLDEFAPNGFDLHLLGMGGEGHINSLFPHTDAVKESSAKVIAVFDSPKPPSERATLTLPAVHSAKRVWLLVSGAEKAEAAAAIVNGEPAVEWPAAGATGSEETVLFLADDAAGNL

SEQ ID NO: 99 - DNA, 2230 bp, Corynebacterium glutamicum
  CDS (101)..(2200): RXA02739
cctttgccaaatttgaaccaattaacctaagtcgtagatctgatcatcggatctaacgaaaacgaaccaaaactttggtcccggtttaacccaggaaggattgaccaccttgacgctgtcacctgaacttcaggcgctcactgtacgcaattacccctctgattggtccgatgtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaactatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggcggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcactgcgcgccatcccaggtctgtccgtcctgcgtcctgcagatgcgaacgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaggctctggaagctgagggcgttgcagctcgcgttgtttccgttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacggttaattgccctgctgtttttagcttcaaccc

SEQ ID NO: 100 - protein, 700 aa, Corynebacterium glutamicum
LTTLTLSPELQALTVRNYPSDWSDVDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 101 - DNA, 1099 bp, Corynebacterium glutamicum
  CDS (101)..(1069): RXA02740
agtaaacactctgacgcttctgtcagagtctgggccttcaacgcaaggtgcacactcaccgcagggatatttaaataataaggactcacaacttaaatatatgagtgatttgaaaatgcaacgttctggaggagaacccttggacacgatcaaggcctatattgcgctaacgaagcccagggttattgaactcctccttgtcgccacaatccccacaatgcttcaggctgaacgcggtgagaacaacattgtgctcatcttgctgactgtgttcggtggctggatgggtgcggccgccgccaacaccttcaacatggtggcagactccgatattgatcagcgcatgggacgcactagggctcgccctttggtgcgccacaccgtgagtaatcgcgacgcctccatttttgcgtgggtcctgacagtggccagcttcttgtggctgtggctgctgtgcgattcgatgctcgccggcatcttcgtgttgatcacgattttcttctacatttttgtctacaccaagtggctgaagcgccgcacgcacatgaatatcgtgtggggcggagccgcaggttgtatgccagtgctcgtcggctgggcagtgatcgttgatcagtttgagccaggcgttccacagcagtggtggcaggcaattgtcctgttcatggtgattttcttctggaccccacctcacacctgggctctggccatgaagtaccgcgaagactacaaggcggctggcgtcccaatgcttcctgtcgtgcgcaccccagtccaggtcaccgcacaaatcgtgtggtactccgtggcaactgtgctgaccaccttcttgctcatcccagcaactggttggatctacgcagcgatcgccgtcatttccggcgtcaccttcttgttcatggccatcaagctgcacctcggcatcaaaaacggtggcaaggtcaagcctctgaagctgtttattttgtccaacaactacttggcagtcctcttcgtggcattgtccgtcgacgcggtcctcggccttgagaccatcggcgagatgctcggctggaccaccaccttcttctaaaagcttgcttttcgacgaaaagatcct

SEQ ID NO: 102 - protein, 323 aa, Corynebacterium glutamicum
MSDLKMQRSGGEPLDTIKAYIALTKPRVIELLLVATIPTMLQAERGENNIVLILLTVFGGWMGAAAANTFNMVADSDIDQRMGRTRARPLVRHTVSNRDASIFAWVLTVASFLWLWLLCDSMLAGIFVLITIFFYIFVYTKWLKRRTHMNIVWGGAAGCMPVLVGWAVIVDQFEPGVPQQWWQAIVLFMVIFFWTPPHTWALAMKYREDYKAAGVPMLPVVRTPVQVTAQIVWYSVATVLTTFLLIPATGWIYAAIAVISGVTFLFMAIKLHLGIKNGGKVKPLKLFILSNNYLAVLFVALSVDAVLGLETIGEMLGWTTTFF

SEQ ID NO: 103 - DNA, 694 bp, Corynebacterium glutamicum
  CDS (101)..(664): RXA03030
gaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccctgaaattgcactgtttgaagatgacctcgaaggtgtttccctctctgttgaccctcgtgccaatggtgtcgatgtggaacgcgttcaggctgtggaagctgcagtcccaaccatcttggctgtgaacttcaccaacccttgggtgctgtctgagatcgagcctggtgccgctgccgtggtgggcacttttgagatcaagccagagttccttctcaaggctttgactggtcaagagggaggaccaaagggcaagctgccattgactgttcctgcttccatgcaggcgattgctgattcccctcgcgatatcccaggcaagttcctcgatgagtcttacacctacgtggactccgcagggatggcctacaagtacggtcacggacttaatttctagattgtaggtagtctcgtgggcacaact

SEQ ID NO: 104 - protein, 188 aa, Corynebacterium glutamicum
VLPLDPAASLKIYPLVTGRTKIDEVQLQLEAAIRAELPGVTLVSSESEADLAIVWARPEIALFEDDLEGVSLSVDPRANGVDVERVQAVEAAVPTILAVNFTNPWVLSEIEPGAAAVVGTFEIKPEFLLKALTGQEGGPKGKLPLTVPASMQAIADSPRDIPGKFLDESYTYVDSAGMAYKYGHGLNF

SEQ ID NO: 105 - DNA, 1537 bp, Corynebacterium glutamicum
  CDS (101)..(1507): RXA03083
gtcacccaggctaattcagcagtaatcatttagacttggaaccgcttaccagtggtttcaacaatgcattcacccagctcacacgtgtggaggtgccttaatggcaaagaggatcgtaattatcggcggtggacctgcaggctatgaagccgcactcgcaggcgctaaatacggtgcagaagttaccgttattgaagatgtcggagttggcggatccgcagtcaccatggactgtgtaccttcaaagtccttcatcgctggtaccggtatcaaaaccgacctccgacgtgctgatgacatgggacttaaccgtgggcttggaaaagcacacctagaaatcgatgcactgaacatccgtgtgaaggaccttgcgaaagcacagtccgaagatatcttgggccagctgcagcgctcagatgtccgcatgattaacggtgtgggccgctttgatgattacaacaccaagcaaaccacccactacattaaagtcacccacagcgatggctccgaagaaaccgttgagtgcgatctggtgctggttgcaactggtgcaaccccccgcattcttaaaggtgcagagccagacggcgagcgcatcttgacctggcgtcaggtctacgacattgaagaactccccacccaccttatcgtggttggttccggtgtgaccggtgcggaatttgtctctgcgtttgctgaactcggcgtcaaagtcaccatggtggcatcccgtgaccgcattttgcctcacgatgacgcagatgccgcagacgtgctggaaaccgttctggctgagcgcggagtatccctggaaaagcatgcccgcgtggagtctgtcacccgcaccgaagacggtggcgtgtgtgttcgcactgctgacggacgagaaatctacggttctcacgcgttgatgactgttggttccattccaaacacggcagatcttggcctggagaacatcggtgttgagctggcaccatccggccatatcaaggttgaccgcgtctcccgcaccaacatccccggtgtgtacgcagcaggtgactgtactgacctattcccactggcgtccgttgcagcgatgcagggccgtatcgccatgtatcacgcactcggtgaaggcgtgagccccatccgtttgaagactgttgccaccgcagtgtttacccgcccagagatcgcagcagtaggtatcacccatgcacaagttgattccggcgaagtgtctgctcgcgtgattgtgcttcctttggctactaacccacgcgccaagatgcgttccctgcgccacggttttgtgaagctgttctgccgccgtaactctggcctgatcatcggtggtgtcgtggtggcaccgaccgcgtctgagctgatcctaccgatcgctgtggcagtgaccaaccgtctgacagttgctgatctggctgataccttcgcggtgtacccatcattgtcaggttcgattactgaagcagcacgtcagctggttcaacatgatgatctaggctaatttttctgagtcttagattttgagaaa

SEQ ID NO: 106 - protein, 469 aa, Corynebacterium glutamicum
MAKRIVIIGGGPAGYEAALAGAKYGAEVTVIEDVGVGGSAVTMDCVPSKSFIAGTGIKTDLRRADDMGLNRGLGKAHLEIDALNIRVKDLAKAQSEDILGQLQRSDVRMINGVGRFDDYNTKQTTHYIKVTHSDGSEETVECDLVLVATGATPRILKGAEPDGERILTWRQVYDIEELPTHLIVVGSGVTGAEFVSAFAELGVKVTMVASRDRILPHDDADAADVLETVLAERGVSLEKHARVESVTRTEDGGVCVRTADGREIYGSHALMTVGSIPNTADLGLENIGVELAPSGHIKVDRVSRTNIPGVYAAGDCTDLFPLASVAAMQGRIAMYHALGEGVSPIRLKTVATAVFTRPEIAAVGITHAQVDSGEVSARVIVLPLATNPRAKMRSLRHGFVKLFCRRNSGLIIGGVVVAPTASELILPIAVAVTNRLTVADLADTFAVYPSLSGSITEAARQLVQHDDLG

SEQ ID NO: 107 - DNA, 919 bp, Corynebacterium glutamicum
  CDS (101)..(889): RXA03150
acacttcttcgcgggatacagtcatgacagtgcaatctcactgtccatagaaatgtaactcatatggaatcgcagtatcataaattgcaatctccccgggttgcagtcgcaaatctggctctccatcccgggtgagcaccatggtctcggatttcagtgcacatactttaacagagtgcgtttcaatgcctgtagtgttccggcaattttgaatgtcgttacgttacccaaggctgaattcctgagctcaccttgtacaagatcagtggaagcccagttcacctctcccctgctcaacaatgggcaaacctgtttccttggtacccgaatccttgctccaaaatcacgttacgcggaagtagtcgatgcattcaccgctttcgctggcagcctgcaggttggagtcacgtcctcccctgacactcagatcggaccgatggcgactgcccggcagcgtgagcgcgtggaatcctacatttcccaaggcaaaaatgctggagcccgcatcactgtcggtggcagccgtccacgagatcttgacgccggattcttcgttgagccaacagtgttcgccgatgtagacaatcgcgcagccattgcccaagatgaaatcttcggaccggtgccctctgttgtttcctaccaagacgatgaacacgccatccaactagccaacgattccgaattcggtctcggcggaactgtctggacgagcgatcccgagcgcggcgctgcattggcccgccgagttcacacaggaaccattggcatcaaccgctatatccctgatcccgccgcaccatttggaggtgtgaaaaacagtggccttggcagagaactcggccccgaaggtcttgcttcctaccaagaaacccaaaccatttatctctaatccaaactgcacctatatataaggagt

SEQ ID NO: 108 - protein, 263 aa, Corynebacterium glutamicum
LQSQIWLSIPGEHHGLGFQCTYFNRVRFNACSVPAILNVVTLPKAEFLSSPCTRSVEAQFTSPLLNNGQTCFLGTRILAPKSRYAEVVDAFTAFAGSLQVGVTSSPDTQIGPMATARQRERVESYISQGKNAGARITVGGSRPRDLDAGFFVEPTVFADVDNRAAIAQDEIFGPVPSVVSYQDDEHAIQLANDSEFGLGGTVWTSDPERGAALARRVHTGTIGINRYIPDPAAPFGGVKNSGLGRELGPEGLASYQETQTIYL

SEQ ID NO: 109 - DNA, 1141 bp, Corynebacterium glutamicum
  CDS (101)..(1111): RXA03216
gctgtatcacagtcagctgcagcaggtggcgaaaccgttgcggtcccagcggctgctctgatccctgcaaacaactagaaactattcagaaagcatcaccatgaaactcggtctctacaacgcgatcttccacgaccgcaccctgccagaagcgctcgcagccatcaaagctgcaggtctcaccggaattgaactcaacaccggcggatttttgcctgcaacccacatcccgaccatcgatgacatcctggtcagcgatgatgcccgcgatgaattcctcgggattttcgaaggcaccggcgtcgacatctacggccttaactgcaacggcaacccgcttcaccccaacaaggcgatcggggacaagcatgccgaagacattcgacgttccatccgcctcgcagagcgcctcggccaaaaccgtgtggtcaccatgtctggtcttcctggtggcgaaccaggcgcgaagtacaccaactgggttgtcaacgcgtggaactccgcagccttggatgtccttgattaccaatgggatatcgcagctgaattctggcgcgagaccgaccgcttcgccgcagatcacggcgtgaaagtggctcttgagctgcacccacagaacatcgtgttcaactccgctgacgtgcataagctcatcgatctcaccggcgccacccacgtgggcgtcgaactggatgcatcacacctgttctggcagcagatggacccaatcgctgtgattgatcacctcggcgagctcatcttccacgccgccgccaaagacgtgcgagttaataaggaatgggctcagctcaacggtgtgctggacaacagcttccgacgccttgacccatccgaaaaccgcaccaacttgggcggcgacgagtgggcgaatgaatggccaaagaactctgcttgggatttcgttgctctgggccgcggtcatgacgttgcttactggaccgaattcctccgcgcacttcaccgcgtcgatccaaacatgctggtcaacatcgaacacgaggatgtttcactcggtcgcgaagaaggcgtcaacgaagccgctaaggtgctgatcgaggccaacaaggcactcgaagagtccctggtttcttaaaaaaactacgcctgccccgcaacgctt

SEQ ID NO: 110 - protein, 337 aa, Corynebacterium glutamicum
MKLGLYNAIFHDRTLPEALAAIKAAGLTGIELNTGGFLPATHIPTIDDILVSDDARDEFLGIFEGTGVDIYGLNCNGNPLHPNKAIGDKHAEDIRRSIRLAERLGQNRVVTMSGLPGGEPGAKYTNWVVNAWNSAALDVLDYQWDIAAEFWRETDRFAADHGVKVALELHPQNIVFNSADVHKLIDLTGATHVGVELDASHLFWQQMDPIAVIDHLGELIFHAAAKDVRVNKEWAQLNGVLDNSFRRLDPSENRTNLGGDEWANEWPKNSAWDFVALGRGHDVAYWTEFLRALHRVDPNMLVNIEHEDVSLGREEGVNEAAKVLIEANKALEESLVS

SEQ ID NO: 111 - DNA, 1156 bp, Corynebacterium glutamicum
  CDS (101)..(1126): RXA03388
aagaaacgttggcaatgatggctgcgttttctcgcgtgcgagaagcctcatccatattggtgcgcgcttcccgaagcttcgtgcgcagttcctgcttagtttggctcataaatctaaggataaccgttattttcggaggggtacgacgattggggttgcgggggcaggtactcttggttccatgagtttgcctatcgatgagcacgtgaacgcggttaaaaccgtcgtagtgcctgctgcaggactgggaacccgattccttccggccaccaaaaccgtacccaaggagttgctgccggttgtcgataccccaggtattgagctgattgctgctgaggctgccgaacttggtgcgaccaggctggcgatcatcactgcgccaaacaaagctggggtacttgcacactttgagcgttcttctgaattggaagaaacgctgatggagcgtggcaagactgaccaggtggagataatccgccgcgccgccgatttaatcaaggcagttccagtaacccaggacaagccgctggggctaggtcatgctgttggtttggctgagtctgtgttggatgatgatgaagatgtcgtagcggtgatgttgccggacgatctcgtgttgccaaccggtgttatggagcgcatggctcaggtccgagcagagttcggtggatctgtcctttgtgcagttgaggtttctgaagctgacgtttctaagtatggcatctttgaaatcgaagctgacaccaaagattccgatgtcaaaaaggtcaagggcatggtggaaaaaccagccatcgaagacgcgccatcacgcctcgccgcgactggccgctacctgcttgaccgaaaaatctttgacgccctgcgccgcatcacaccaggcgctggcggcgagttgcagctcaccgacgcgattgatttgcttatcgacgaaggccatccggtccatatcgtcattcaccagggcaaacgccacgatcttggcaaccctggcgggtacattccggcgtgtgttgatttcggtctgtcccaccctgtttatggtgcgcagctaaaagatgcaatcaaacagattttggctgaacatgaagctgcggaacgtattgcagacgattctcaagtaaaatagctgcctggttccgattaggaggtccgt

SEQ ID NO: 112 - protein, 342 aa, Corynebacterium glutamicum
LAHKSKDNRYFRRGTTIGVAGAGTLGSMSLPIDEHVNAVKTVVVPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVK

SEQ ID NO: 113 - DNA, 727 bp, Corynebacterium glutamicum
  CDS (101)..(697): RXA04088
ctctgcacacgttttattgattgtgcagcaataaatcgaggttcaaaacataggaccgcattagcgattagcgcgcgctgagctttagtttacagctaacatgaggtgcataaacaaaacggtagatcagcaaatcgcactgtttgggcaatcgggaagcggaaaaactgcattattgtgctctttttatggtaccgcacgggaatcctcgcaagaggacgtgaaattattcgagatctctgccgaagatgatcgacacacagaattgatgagactgtatctgggaatgagagatgattcgcttttcccacctgcgaatcgatttgagtcaaaaaatacagtcttttctctgaaacaaaaaggtgttccgattaaagaagcacggaaggcagatcaggtccgggtgacctggaatgattatcctggcgagtggttcgagggaggggccacgacggaatcagaaaaacaggacaagatcaatacttttagaaacctgttgggttcagacgtagcactctttttggttgatgggcaaaggcttcatgactatgccgatgatgaggagcgctatcttacgtacctttttgatagcttcactgaatccttgagccaaatcaaagaggcgattttggaggatggtacaccgctccaacagttccctcgcatctgggtgattgctttgtctaaagctgatttatagccggatctcacggttacagaattcgaa

SEQ ID NO: 114 - protein, 199 aa, Corynebacterium glutamicum
MRCINKTVDQQIALFGQSGSGKTALLCSFYGTARESSQEDVKLFEISAEDDRHTELMRLYLGMRDDSLFPPANRFESKNTVFSLKQKGVPIKEARKADQVRVTWNDYPGEWFEGGATTESEKQDKINTFRNLLGSDVALFLVDGQRLHDYADDEERYLTYLFDSFTESLSQIKEAILEDGTPLQQFPRIWVIALSKADL

SEQ ID NO: 115 - DNA, 2155 bp, Corynebacterium glutamicum
  CDS (101)..(2125): RXA04279
cttgatatgacccgaacaccacacatcacaaattgaatcggtatcctttggggtattagtttccgttttaacgacacgacttgcgaggagtcttaaaataatggcgttctccgtagagatgcccgagctgggcgaatcagtaaccgaaggcacgatcacccagtggttgaagtctgttggtgacactgttgaggtagatgagccgttgctcgaggtctcaactgacaaggtcgacaccgagattccctctcctgtcgccggtgtcatcctagagattaaggctgaagaggatgacaccgtcgacgtcggcggtgtcattgcaataatcggcgatgctgatgagactcctgccaacgaagctcctgccgacgaggcaccagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaggaaccagttaaggaagagccaaagaaggaagagcccaagaaggaagagcccaagaaggaagcagctactacacctgctgcggcatccgcaactgtgtccgcttctggcgacaacgttccatacgtcaccccactggtgcgcaagcttgctgaaaagcacggcgttgacttgaacaccgtgaccggtaccggtatcggtggccgtatccgcaagcaggatgttttggctgctgcgaacggcgaggctgcacctgctgaggctgctgctcctgtttccgcttggtccactaagtctgttgaccctgagaaggctaagctccgtggtaccactcagaaggtcaaccgcatccgtgagatcaccgcgatgaagaccgtcgaggctctgcagatttctgctcagctcacccagctgcacgaggtcgatatgactcgcgttgctgagctgcgtaagaagaacaagcccgcgttcatcgagaagcacggtgtgaacctcacttacctgccattcttcgtgaaggcagttgtcgaggctttggtttcccatccaaacgtcaacgcgtctttcaacgcgaagaccaaggagatgacctaccactcctccgttaacctctccatcgctgttgataccccagctggtctgttgaccccagtcattcacgatgctcaggatctctccatcccagagatcgcaaaggcaattgttgacctggctgatcgttcacgcaacaacaagctgaagccaaacgatctgtccggtggcaccttcaccatcaccaacattggttctgaaggcgcactgtctgataccccaatcctggttccaccacaggctggcatcttgggcaccggcgcgatcgtgaagcgtccagttgtcatcaccgaggatggaattgattccatcgcgatccgtcagatggtcttcctaccactgacctacgaccaccaggttgtagatggcgcagatgctggtcgcttcctgaccaccatcaaggaccgccttgagaccgctaacttcgaaggcgatctgcagctctaagatctctgcaagttaaaaccgccactc

SEQ ID NO: 116 - protein, 675 aa, Corynebacterium glutamicum
MAFSVEMPELGESVTEGTITQWLKSVGDTVEVDEPLLEVSTDKVDTEIPSPVAGVILEIKAEEDDTVDVGGVIAIIGDADETPANEAPADEAPAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVPYVTPLVRKLAEKHGVDLNTVTGTGIGGRIRKQDVLAAANGEAAPAEAAAPVSAWSTKSVDPEKAKLRGTTQKVNRIREITAMKTVEALQISAQLTQLHEVDMTRVAELRKKNKPAFIEKHGVNLTYLPFFVKAVVEALVSHPNVNASFNAKTKEMTYHSSVNLSIAVDTPAGLLTPVIHDAQDLSIPEIAKAIVDLADRSRNNKLKPNDLSGGTFTITNIGSEGALSDTPILVPPQAGILGTGAIVKRPVVITEDGIDSIAIRQMVFLPLTYDHQVVDGADAGRFLTTIKDRLETANFEGDLQL

We claim:

1. An isolated nucleic acid molecule selected from the group consisting of:
   a) an isolated nucleic acid molecule encoding the amino acid sequence set forth in SEQ ID NO:2, wherein either (i) the amino acid residue at position 75 of SEQ ID NO:2 is any amino acid except proline; (ii) the amino acid residue at position 413 of SEQ ID NO:2 is any amino acid except glycine; or (iii) the amino acid residue at position 417 of SEQ ID NO:2 is any amino acid except alanine: or a complement thereof;
   b) an isolated nucleic acid molecule comprising the nucleotide sequence set forth in SEQ ID NO:1, wherein the nucleic acid molecule comprises one or more nucleic acid modifications as compared to the nucleotide sequence set forth in SEQ ID NO:1 such that either (i) nucleotide residues 323–325 of SEQ ID NO:1 encode any amino acid except proline; (ii) nucleotide residues 1337–1339 of SEQ ID NO:1 encode any amino acid except glycine or (iii) nucleotide residues 1349–1351 of SEQ ID NO:1 encode any amino acid except alanine; or a complement thereof; and
   c) an isolated nucleic acid molecule comprising the nucleotide sequence set forth in SEQ ID NO:1, wherein the nucleic acid molecule comprises one or more nucleic acid modifications either (i) at nucleotide residues 323–325 of SEQ ID NO:1 such that nucleotide residues 323–325 of SEQ ID NO:1 encode any amino acid except proline; (ii) at nucleotide residues 1337–1339 of SEQ ID NO:1 such that nucleotide residues 1337–1339 of SEQ ID NO:1 encode any amino acid except glycine or (iii) at nucleotide residues 1349–1351 of SEQ ID NO:1 such that nucleotide residues 1349–1351 of SEQ ID NO:1 encode any amino acid except alanine: or a complement thereof.

2. The isolated nucleic acid molecule of claim 1(a) wherein the amino acid residue at position 75 of SEQ ID NO:2 is serine.

3. A vector comprising the nucleic acid molecule of claim 1.

4. The vector of claim 3, which is an expression vector.

5. An isolated host cell, which is transfected with the vector of claim 4.

6. The host cell of claim 5, wherein expression of said nucleic acid molecule modulates the production of a fine chemical from said cell.

7. A method for preparing a fine chemical, comprising culturing the cell of claim 5 such that the fine chemical is produced.

8. The method of claim 7, wherein the fine chemical is an amino acid.

9. The method of claim 8, wherein said amino acid is lysine.

10. The host cell of claim 5, wherein said cell is a microorganism.

11. The host cell of claim 10, wherein said cell belongs to the genus *Corynebacterium* or *Brevibacterium*.

12. The host cell of claim 6, wherein said fine chemical is selected from the group consisting of organic acids, proteinogenic and nonproteinogenic amino acids, purine and pyrimidine bases, nucleosides, nucleotides, lipids, saturated and unsaturated fatty acids, diols, carbohydrates, aromatic compounds, vitamins, cofactors and enzymes.

13. The method of claim 7, wherein said cell belongs to the genus *Corynebacterium* or *Brevibacterium*.

14. The method of claim 6, wherein expression of the nucleic acid molecule from said vector results in modulation of production of said fine chemical.

15. A method for producing a fine chemical, comprising culturing a cell whose genomic DNA has been altered by the inclusion of a nucleic acid molecule of claim 1.

16. The isolated nucleic acid molecule of claim 1(a) wherein the amino acid residue at position 413 of SEQ ID NO:2 is glutamic acid.

17. The isolated nucleic acid molecule of claim 1(a) wherein the amino acid residue at position 417 of SEQ ID NO:2 is valine.

18. The nucleic acid molecule of claim 1(b) or (c), wherein nucleotide residues 323–325 of SEQ ID NO:1 encode serine.

19. The isolated nucleic acid molecule of claim 1(b) or (c), wherein nucleotide residues 1337–1339 of SEQ ID NO:1 encode glutamic acid.

20. The isolated nucleic acid molecule of claim 1(b) or (c), wherein nucleotide residues 1349–1351 of SEQ ID NO:1 encode valine.

* * * * *

UNITED STATES PATENT AND TRADEMARK OFFICE
CERTIFICATE OF CORRECTION

PATENT NO.         : 7,141,664 B2                                              Page 1 of 1
APPLICATION NO.  : 10/494836
DATED              : November 28, 2006
INVENTOR(S)        : Oskar Zelder et al.

It is certified that error appears in the above-identified patent and that said Letters Patent is hereby corrected as shown below:

In the Claims:

In Claim 1, column 37, line 11, replace the punctuation mark ":" with --;-- so it should correctly appear as --; or a complement thereof--;

In Claim 1, column 37, line 34, replace the punctuation mark ":" with --;-- so it should correctly appear as --; or a complement thereof--;

In Claim 14, column 38, line 22, replace "claim 6" with --claim 7-- so it should correctly appear as --claim 7--;

Signed and Sealed this

Seventeenth Day of April, 2007

JON W. DUDAS
*Director of the United States Patent and Trademark Office*